United States Patent 11,098,302 (IDENTIFICATION OF POLYNUCLEOTIDES ASSOCIATED WITH A SAMPLE) - sequence listing, part 104

SEQ ID NO: 357276 - DNA, 718 bp, Homo sapiens
  misc_feature: GZ8MTXP02IJ9EF.22.36.D03.1.454.CMB.2.raw
  modified_base (332)..(332): a, c, t, g, unknown or other
  misc_feature (332)..(332): n is a, c, g, or t
tcagacatacgcgtcacgaccggtgctcgatttagctgcgtcacgatctctcttgggggagagaggagcccagcccctgggattttcaggttgttttcatttggtgatcaggactgaacagagagaactcacatggagtttgggctgaagtggcttttgcttgtggctaattttaaaaggtgtcaagtgtgcggtgaaggtattggagtcgtgggggagcttggtacgaggccggggggtccctgacactctccgtgtgcagcctctggattcacagtcagcagcaatgccatggagtttcgggccgccgaggctccggaagggaggggttncgagtggggtctcggggattgggaagtggagtggtcgcccaagacaactcgcgacggtacctcccggtagggaccgggggtcccactttcactacacgtccctccgaagacgaacccgtaacttaaaccccgaaaaacaccgtaggtacgtaaagtccctaggtaaacctaaaaagtcgttaaacccgacgtaccccgttaccgaaacggcccggaccgggaaacggtaacccgaacccgggtcccgtttaccttaacccgtttgacggttacggaaaccggtaaaacgttccccctttaggtttaaccgggtttttcccgggcccggacccgggtaccccggttaaaccgtaccggggttacccgggggtacccgtaacccgggg

SEQ ID NO: 357277 - DNA, 679 bp, Homo sapiens
  misc_feature: GZ8MTXP02GWCE1.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtatggagtcgtgggggagcttggtacgaggccggggggtccctgaccactctcctgtgcagcctgtggattcacagtcagcagcaatcgccagtggtaggttcgggtccgcgacggccgtaccggaagggggtaaggggttcgcgtagggtcggggtcgtacggggtagttaggggaagtggaggtcgggtacgacccacgaccgtacgtaacgcgaacgccgtccggtagggaccgggggtcctctttacgacgtcactccctaccggaagaacgaacgtaccgttaaaccgaaaacacgtaagtacgtaaactcgtaacgactaaagttcgaacaccgaccgtacgacgccggaccgaggtacccgacggtcccgttactacgttcgacgtacgaaccgtaaacgttcccttacgtttaacggtttccgggacccggtaccggacccgacggtaccgggtccggggaccgtaaccggg

SEQ ID NO: 357278 - DNA, 632 bp, Homo sapiens
  misc_feature: GZ8MTXP02JYZ7F.22.36.D03.1.454.CMB.2.raw
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
  modified_base (375)..(375): a, c, t, g, unknown or other
  misc_feature (375)..(375): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacagtgactagttgggtcttttgactctgtctcctgtaccaacaacacccacgaccaaaccccccactcatctattagtgtntcactcgtccgccctgaggactctcctcatcgcttcncagcctccaagtcgtggaccaacnccggccctaccctaaccatcctacgtcgggcctcgtagtttagacggtacgacgttcgttactttaacttactacgtcttaacgtttacctttaaagttacggtccgtaccctacttccgttcggtttcgggtttacgggacggtacggtcccgtaaacgggtaacggtccggtacccgttccgttaccgggtactaaccggccccggtaacggtcccgtacccggtccccccgtcgggtaccctaccgtttccccg

SEQ ID NO: 357279 - DNA, 710 bp, Homo sapiens
  misc_feature: GZ8MTXP02HSA8E.22.36.D03.1.454.CMB.2.raw
  modified_base (526)..(526): a, c, t, g, unknown or other
  misc_feature (526)..(526): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggaggtcgtgggggaggtcgttggtacgacgggcccgggggggtccctggaccacctcctccgtgtcgcacgcctcgtgtacttcacagtcagcagcaatgccagtggtacggtttcggccccgccggacggtccgtaccgggaaggggtaaggggttcgacggtaggggttcggggtacggtacgggggtagttaggggtaaagtggtaaggtgggtaccgacccaacacgtaccgtacgcgacggtaccgtccggtggggaccggggcccgtcttccgactcacttccaccgagtaccgaacgtaacctaaccgaaaacncgtagtacgatacgtagaaactaatcgtaacacgacctacgaccggaccgccggaacggacccgaaccgtcccggtacttaccgtttcgacggtacgaaccgtaacgtacccgtttagtttacggtttcccgggaaccggtccgggtacccggtaccgtacgggtccggggtacccgacccggg

SEQ ID NO: 357280 - DNA, 576 bp, Homo sapiens
  misc_feature: GZ8MTXP02FPBP6.22.36.D03.1.454.CMB.2.raw
  modified_base (303)..(303): a, c, t, g, unknown or other
  misc_feature (303)..(303): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctgacactctcctgtgcagcctctggattcacagtcagcagcaatgccatgagttcggccncgaggctcgaggggagggtgcgaggtgggtcgtcggggtattgggaagtgagtggcgccacacactacgcacgaccgtcggtggacggggcctcttcatcatcctacgagagacgacttaccgaaaactcagtgaaatctagacaatcgaacagcctcgacgcgacgacgtacgcgggtcctactacttgtacgtcgaaccgtaaacgtaccgttcgtttacggtttcgggacccgtccggtaccgtacgttacggcggggaccgtaaccggg

SEQ ID NO: 357281 - DNA, 701 bp, Homo sapiens
  misc_feature: GZ8MTXP02GRQXR.22.36.D03.1.454.CMB.2.raw
  modified_base (219)..(219): a, c, t, g, unknown or other
  misc_feature (219)..(219): n is a, c, g, or t
tcagacatacgcgtcacgaccggtgctcgatttagctgcgtcacgatctctcttgggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtagggaccaacgagtgactagtttcgggtcttttgacttctgtcctctacggtaaccaacaacacccacgacccaaaccccccatcatctattagtgtctacactcgtccgccctgaggactctctccgtactcgtcttctcacggtctccgaacgtcgtacggacaaccgtaccgtcccctaccctaaacctcttacgtcgtcgggtcccttacgtacgttcgaacgggtacgtacgttaccttaactttacttacgtacgtactttaacgtttacctttaaaggttacggcctaacctacgttcgttcggggtttacggtttccggggacgggtaaccggtaccgtaaaccgggttaaacgtcccggtaaaccccggttccggttacccggtaacgaccccggtaacccggaaccgggtcccgtacccccggttacccccttccggttaccctacccgttcccgtttcccccggg

SEQ ID NO: 357282 - DNA, 595 bp, Homo sapiens
  misc_feature: GZ8MTXP02GD9QK.22.36.D03.1.454.CMB.2.raw
  modified_base (233)..(233): a, c, t, g, unknown or other
  misc_feature (233)..(233): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgacattggtctttgactctgtctctggtaccaacaacacccaggaccaaaccccccactcatcatttatgtgtaactcgtcggccctcaggagtctctccatcgcttctcaggctccaagtctggacaacaccggtccctaccctaaaccatcctcgtcgggctccgtagtttcgagacgtagtcttacttattactgtactacgtttacctttaaaagtcggacctacctacgttcgttcggtttgggttttccggcgggtacgtacgtaaccggagttcgacccgttccgtccgtacgaccgtccccgaaagggtcccttccggccccccgttaggtaccctaccttcccgtttcccg

SEQ ID NO: 357283 - DNA, 707 bp, Homo sapiens
  misc_feature: GZ8MTXP02HUCJ0.22.36.D03.1.454.CMB.2.raw
  modified_base (290)..(290): a, c, t, g, unknown or other
  misc_feature (290)..(290): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttggtacgaggcccgggggggtccctgaccactctcctgtgcagcctctggattcacagtcagcagcaangccatgaggtttcgggcccgccgaggcctccggaggggtaggggttgcgaggtgggtcgcggggtagttagggaagtggacgtgggtcgccacgacaacgtacgccgaggtacctccggtgggacggggcccgtctttccactcgactcctacccaggacgaacgtaccgttaacccggaaaaacaccgtaagtacgtaaacgttaccgttagaaactaaattacggtacgaccgtacccgtacgacgacccggaccggaccggaaccgacccggggtaccccgttccgtttacctttcgtacgtacggtaaccgtaaaaccggttaccctttaccgtttacggtttttccggggccccggtacccgggtaccccggtaccggtaccgggttacgggggtccccggaaccccggggg

SEQ ID NO: 357284 - DNA, 660 bp, Homo sapiens
  misc_feature: GZ8MTXP02IEDDM.22.36.D03.1.454.CMB.2.raw
  modified_base (217)..(217): a, c, t, g, unknown or other
  misc_feature (217)..(217): n is a, c, g, or t
  modified_base (311)..(311): a, c, t, g, unknown or other
  misc_feature (311)..(311): n is a, c, g, or t
  modified_base (354)..(354): a, c, t, g, unknown or other
  misc_feature (354)..(354): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctgatcatctgacagtcgatcagctatttccngcacgtcgggaaccaacgagtagactagttggtctttgactctgtctcctgtaccaacaacacccacgacccaaacccccatcatcattatgtntcacgtcgtccgcctagacggtatctccctacactcgtcttcncgtacggtcctaccgaaagtcgtacgaccaaccgtacccgtaccctaccccctaaccacttcctcggtacggcccttacccgtagtttacggaacggtaccgtagttacctaactttaacgttaccgttagtaccttaacgtttttaaccgtttaaaacgttaaccggtccgtacccgtacgtttccgttacgggtttcgggtttccgggacggtacggtacccgtacggaaacgtcggacccgttccgtacgtaccgacgcccgtaacggccctcccggaccccgttcggtacctaccgttcccg

SEQ ID NO: 357285 - DNA, 629 bp, Homo sapiens
  misc_feature: GZ8MTXP02FV9WS.22.36.D03.1.454.CMB.2.raw
  modified_base (304)..(304): a, c, t, g, unknown or other
  misc_feature (304)..(304): n is a, c, g, or t
  modified_base (465)..(465): a, c, t, g, unknown or other
  misc_feature (465)..(465): n is a, c, g, or t
  modified_base (522)..(522): a, c, t, g, unknown or other
  misc_feature (522)..(522): n is a, c, g, or t
  modified_base (592)..(592): a, c, t, g, unknown or other
  misc_feature (592)..(592): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactctcctgtgcagcctctggacttcacagtcagcagcaatgccatgagttcggtccncgaggcctaccggaggggaacggggtttgacgtagggtgggtcgtcggggtattggaaaggtgacttggggtcaccacgacacctacgcacgacctcggtggacggggccctcttcactcaacttcaccgagacgacgacttaaccgaaaactcgaagtanaaacttcagaacctaaattcggaacacgcccagaacggccggtaccggaggaaaccnccggggtaccctacttacgttcgtacgtacgaacgtaaaacgtcccttgtttaacgtttcggggaacccncgggtacccgacgttacgggcggggaccgaaccgggg

SEQ ID NO: 357286 - DNA, 656 bp, Homo sapiens
  misc_feature: GZ8MTXP02G6S4P.22.36.D03.1.454.CMB.2.raw
  modified_base (237)..(237): a, c, t, g, unknown or other
  misc_feature (237)..(237): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggacccaaagngtgactagtttgggtcttttgactctcgtctcctaggtaacccaacaaccaccccgacggaccccaaaaccccccatccatactatttagtcggttcgtacaccgttcgtccggcccttgaggacttctcctcattcgctttcgcgacggtcctaccgaacttcgtacggacctaaaccgccggtaccctacccgtaaaccacgttcccgtacgttcgggccttaccgttaggtttacgaagggtaacctacgttccttaaacgtttacttaccgtataccgttacgttttaactttaaaagtcggcctacccgtacttcgttcgggtttcggtttcggaggttcgacgtacgtacgtcgtacccgttcgtcggacctacgccgtaagtcccgccgtccccgtacgtctaccgttcccg

SEQ ID NO: 357287 - DNA, 674 bp, Homo sapiens
  misc_feature: GZ8MTXP02HB2A2.22.36.D03.1.454.CMB.2.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (238)..(238): a, c, t, g, unknown or other
  misc_feature (238)..(238): n is a, c, g, or t
  modified_base (314)..(314): a, c, t, g, unknown or other
  misc_feature (314)..(314): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaangtnactagttggtctttgactctgtctccgtgaaccaacaaccacccagaccccaaaccccccatcatctattatggtntctactccgtccgccctacgaggtactctccctcatcgtacttctcgacgtcctacgaagtctcgaccaaaccgccgtcccctacccctaaacacttcctccggtcgggtcccttaccgtacggtttggaacggtacgtacgttcttaaacgtttacttaccgtgttaccgttaacgttttaaccgtttaaacgtaccggtacctacccgttacgtttacgttccggtttacggggtttccgggaccgggtacggtaccgtaccggtaacggtaccggtaccccggttcgtaccggtacgtaccggtaaccgaacggtcccgtcccggtacccccgttcggtacccgtacccgtttcccg

SEQ ID NO: 357288 - DNA, 644 bp, Homo sapiens
  misc_feature: GZ8MTXP02IR1ZG.22.36.D03.1.454.CMB.2.raw
  modified_base (303)..(303): a, c, t, g, unknown or other
  misc_feature (303)..(303): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccgggggggtccctgacactctcctgtgcagcctctggattcacagtcagcagcaatgccatgagtgggtccncgaggctccgaggggaaggggttgcgaggtgggtagtcggggattgggaaagtgagtggtcgccacacactacgcagacgtccgtaggacgggggcctcttcgtactcgtaactcctaccgaacggaacgaacgtaacgttaaaccggaaaaaccacgaaacgtagtaaacgtaccgttagacctaaattacgtacaacgcccctagacgccggaccgacgggaaccgaccgacccggttacttacgttccttggtagtaaccggaaacgtaccgttccgtttaagttttcgggcccggtccgggtacccggaccgtacggttacgggggccgaaccgggg

SEQ ID NO: 357289 - DNA, 702 bp, Homo sapiens
  misc_feature: GZ8MTXP02IFY7I.22.36.D03.1.454.CMB.2.raw
  modified_base (309)..(309): a, c, t, g, unknown or other
  misc_feature (309)..(309): n is a, c, g, or t
  modified_base (416)..(416): a, c, t, g, unknown or other
  misc_feature (416)..(416): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtagttggagtcgtgggggaggcgttgggtacgaggccgggggggtccctgacactctcctgtgcagcctctggattcacagtcagcagcaatcgccatgagtttgggcccncaggctaccggaggggaaggggttgcgagggtgggtctcgggggatttgggagtgacgtggggtcgccacaacaccgtacgcacgactccggtggacgggggccctnttccgattcactctaccaggaacgacgtacttaccgaaaaacctacgaaacggttagaaacttccgtagtaacctaaaagtacggttaacacggtaccctacgacggaccggacccgggaacgggtaacccgacccgggtacccggtttacctaaccgttttcccggaggtttaaccggaaccggtaaaaaccgttcccgtttaactttaccggggtttttaaccgggcccggtaccgggtaccccggtacgttaacccgggttcgggggacccgtaacccggggg

SEQ ID NO: 357290 - DNA, 772 bp, Homo sapiens
  misc_feature: GZ8MTXP02H6P8I.22.36.D03.1.454.CMB.2.raw
  modified_base (280)..(280): a, c, t, g, unknown or other
  misc_feature (280)..(280): n is a, c, g, or t
  modified_base (432)..(432): a, c, t, g, unknown or other
  misc_feature (432)..(432): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggcttggtacgaggccggggggtccctgacactctcctgtgcagcctctggattcacagtcancagcaatgccatggtacggtttcgggcccgccgacggctccggaggggtaagggttgcgagggtcggggtctcgggggattagggaagtgacgtcgggtcgacccacacgaccgtacgcgaacgaccgttccgggtaggaccgggggtcccncgtttacactacgacttacccgtacccgaaggaacgaacgtaacgttaacccgaaaaaccaaccgtaacgtagaaacttcgtaacgtaacctaaaagtacggtaaccgaaaccgtacccgtacgaaccgggacccggacccggaacgggaacccgtacccgggtaccccggtttaacccggtttaacccttccggtttacggttaccggaaaccggtaaaaccggttaaaccccgtttccggttttaaaccggtttttaaccgggggccccgggttaaccggggtacccccggtaaccggtttaaccccggggtcgggggtaaccccggtaacccggggg

SEQ ID NO: 357291 - DNA, 642 bp, Homo sapiens
  misc_feature: GZ8MTXP02JQ7IU.22.36.D03.1.454.CMB.2.raw
  modified_base (235)..(235): a, c, t, g, unknown or other
  misc_feature (235)..(235): n is a, c, g, or t
  modified_base (306)..(306): a, c, t, g, unknown or other
  misc_feature (306)..(306): n is a, c, g, or t
  modified_base (341)..(341): a, c, t, g, unknown or other
  misc_feature (341)..(341): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacngtgactagttggtctttgactctgtctctgtaccaacaacaccagacccaaacccccatcatcattatgtntcactcgtcgcctcgagtctctcctcatcgcttcncacggtcctaccaagttcctacggccaaacgacccggtccccttacccgtaaaccctcttacccgtcgtcggggtcccttaccgtacggtttacggacggtaaccgtacgttacctttaacgtttaactttacctacggtaccttaacgtttacctttaaaagttacggaccgtacctacgttcgttaccggttcgggtttcgggaccggtacggtccgtaaccgtacggttcgtacccgttccgtacggtaccacggtcccgaacggtccgtcccgtaccccgttcggacctcgttcccg

SEQ ID NO: 357292 - DNA, 651 bp, Homo sapiens
  misc_feature: GZ8MTXP02IE4IT.22.36.D03.1.454.CMB.2.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (307)..(307): a, c, t, g, unknown or other
  misc_feature (307)..(307): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaanagtgactagttgggtcttttgactctgtctcctggtaccaacacaccagaccaaccccccatcatcatttanggtgtcactcgtcgccctcgaggagtctcctctactcgtcttctacgaggtcctaccgtaagtccgtacggaccaaccgacggtccccctacccctaaccacttcctcgtacgggccttaccgtagtttcgaggtaccgtagttacttactttaagtttacctagtacgttaacgtttacctttaaaacgttcgggacctcctacgttcctttcggttcgggttttccgggacggtacggtaccgtacccggtaacgttaccggtacccggttcccgtcgggttaccaccggtaacccgaaacggtccgtaccgtcccccgttccggtacctacccgtttcccg

SEQ ID NO: 357293 - DNA, 611 bp, Homo sapiens
  misc_feature: GZ8MTXP02I2EX8.22.36.D03.1.454.CMB.2.raw
  modified_base (254)..(254): a, c, t, g, unknown or other
  misc_feature (254)..(254): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattggtctttgactntgtctctgtaccaacaaccaccagacccaaacccccatcatcattangtcncactcgtccgccctgaggagtcctcctcatcgtccttctcgaggtcctaccaagtccgtcggaccaaacgccggtcccttacccctaaacctactccttacgtcgggtcccttacccgtaggtttcggaacggtacgtacgttccttaactttacttaactcgtacttacgtttaccttttaaaagttcggaccgtacctacgttccgtcggtttagggtttcgagggtacgcgtaacggaacgtcgaccgttccgtcggtacacggaaccgacggtcctcgcccccgtacggtcctacgttcccg

SEQ ID NO: 357294 - DNA, 659 bp, Homo sapiens
  misc_feature: GZ8MTXP02JLB85.22.36.D03.1.454.CMB.2.raw
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
  modified_base (315)..(315): a, c, t, g, unknown or other
  misc_feature (315)..(315): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactcgggaaccaacagtgactagttggtactttgactctgtctccgtcgtaccaacaacacccagaccccaaacccccancactactattangtntcactcgtcgaccctgagctctctcatcnttcncagctcaagtcgngacacgaccgtccctacctaccactctcgtcggcctaccgtgtttcggaacgtacgtacttacgttactttacttactcgtacttacgttttaccgttaaagttacggccgtacccttacgttccggtttacggtttcggggtttaccgggacgggtaacgggtacccgtaaacccggtaacggggttccgtaaccccggttccgtttacccgggccgtaacccgggtaacccgtaaaccgggtcccgttcccccggtacccccgtttccggttaccgtaaccccttttcccccgggg

SEQ ID NO: 357295 - DNA, 696 bp, Homo sapiens
  misc_feature: GZ8MTXP02HC3I8.22.36.D03.1.454.CMB.2.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
  modified_base (311)..(311): a, c, t, g, unknown or other
  misc_feature (311)..(311): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtggaccaacngtgactagttggttctttgactctcgtctcctgtaccaacaaccacccacgaccccaaacccccatacatctattangtagtaactcgtcgcctcgagtacgtctctcatcgtcttctcgtacgctccgaagtcgtacggaccaaccgtaccggtcccctaaccccgtaacctattcccgtaccgtcgggtaccttcccgttaggtttcggaacggtaccgttaacgttaccttaacgtttaacgttaccgtacggtactttaacgtttaaccctttaaacggttacgggacccgttacccgtaacgttccggtttacgggtttaccgggtttccgggacggggaccggtaccgaaccggtacggtacccggtacccgttcccgtaccggtaccgacccggacccgtaaccggtcctaccccggttcccccgtacggtaccctaccgttccgtttacccccg

SEQ ID NO: 357296 - DNA, 583 bp, Homo sapiens
  misc_feature: GZ8MTXP02H4X7R.22.36.D03.1.454.CMB.2.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
  modified_base (304)..(304): a, c, t, g, unknown or other
  misc_feature (304)..(304): n is a, c, g, or t
  modified_base (344)..(344): a, c, t, g, unknown or other
  misc_feature (344)..(344): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgaccccagcctgcctccgtgtctggatcatctggacagtcgatcagcatttccngcactgggacccaanagtgacagttggtctttgactctgtctcctgtaccaacaacacccagccaaacccccactcatcatttangtgtcactcgtcgcctcaggacgtctcctcactcgcttcncgacggcctacctaagtctggaccaaccgaccggccctaaccctaacatcctacgtcgggccttaccgtagtttcggacggtaacgtgttacttacttattactgtcttacgtttacctttaaagtacggcctacctacgtcttcggttgggtttcggacggtaggcctaaacggcgtacggaccgtcgtccggtcaccggccgaacggcctccgtcccccgtcggtcctacgttcccg

SEQ ID NO: 357297 - DNA, 672 bp, Homo sapiens
  misc_feature: GZ8MTXP02JD0L5.22.36.D03.1.454.CMB.2.raw
  modified_base (235)..(235): a, c, t, g, unknown or other
  misc_feature (235)..(235): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctgccctgacccagcctgcctccgtgtctggatcatctggacagtcgatcagctatttcctgcacgtgggaccaanagtgactagttggttctttgactctgtctcctgtaccaacaaccaccacgacccaaacccccatcatcattagtgtactaactcgtccggcctcagtctctctccatcgtcttctcgacgtctccgaagtctacggaccaaccgccgtaccctaccctaaacctactcctcgacgggtccttaccgtagtttcgaacggtaacgtgttactaacgtttactacgtacgtacttaacgtttaccgtttaaacgtacggtacctaccttacgttcgttacggggttttccgggtttaccgggacgggtaacggtccgaaccggttaaacggtccggtaaaccccgttccggtaccggttaccgaccggtaacccgtaaccgggtcccctcccggtaccccccggttacggttaccctacccgtttcccgtttacccccg

SEQ ID NO: 357298 - DNA, 558 bp, Homo sapiens
  misc_feature: GZ8MTXP02JVCWU.22.36.D03.1.454.CMB.2.raw
  modified_base (219)..(219): a, c, t, g, unknown or other
  misc_feature (219)..(219): n is a, c, g, or t
  modified_base (260)..(260): a, c, t, g, unknown or other
  misc_feature (260)..(260): n is a, c, g, or t
  modified_base (297)..(297): a, c, t, g, unknown or other
  misc_feature (297)..(297): n is a, c, g, or t
  modified_base (309)..(309): a, c, t, g, unknown or other
  misc_feature (309)..(309): n is a, c, g, or t
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
  modified_base (374)..(374): a, c, t, g, unknown or other
  misc_feature (374)..(374): n is a, c, g, or t
  modified_base (393)..(393): a, c, t, g, unknown or other
  misc_feature (393)..(393): n is a, c, g, or t
  modified_base (405)..(405): a, c, t, g, unknown or other
  misc_feature (405)..(405): n is a, c, g, or t
tcagacatacgcgtcacgaccggtgctcgatttagctgcgtcacgatctctcttggggggggtctcaggaggcagcgctctcgggacgtctccaccatggcctgggctctgctattccctcaccttcctcactcagggcacagggtcctgggcccagtctgccctgacccagcctgcctccgtgtctggatcatctggacagtcgatcagctatttccngcactgggaccaacgagtgactagttgggttcttttgactntgtctcctgtaccaacacaccacgaccaaacccccancatcattatgtntcactcgtcgcctcagtatctctccatcgcttcncagctcagtcngacacncgcctccaccntcnctggctcgtgtcgagcgtntctattatactnacttacgttactttaagtacgccgtacctacgtcgttcgtttggtttaccggcggtacggtaccgacggtaacggtcggtacccgttccggtcggtaccacgacccgtaaggcccttacccgccccgtaccggtcctaccgttcgttaccccg

SEQ ID NO: 357299 - DNA, 596 bp, Homo sapiens
  misc_feature: GZ8MTXP02HI4X8.22.36.D03.1.454.CMB.2.raw
  modified_base (219)..(219): a, c, t, g, unknown or other
  misc_feature (219)..(219): n is a, c, g, or t
  modified_base (305)..(305): a, c, t, g, unknown or other
  misc_feature (305)..(305): n is a, c, g, or t
  modified_base (345)..(345): a, c, t, g, unknown or other
  misc_feature (345)..(345): n is a, c, g, or t
  modified_base (374)..(374): a, c, t, g, unknown or other
  misc_feature (374)..(374): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaacagtgactattggtctttgactctgtctctgtaccaacaacacccagacccaaaccccccatcatcatttanggtctcactcgtcgccctgaggactctctcatcgtcttcncgaggtcctacctagtccgtcgaccaacnccggtccctaccctaaactacttcctccgtgggtcccttccgtagtttacggaaggtaccgtagtacttacgtttattaccgtgttacctaagtttaccctttaaagtacggctaccacgttcgttacggtttgggttccgacggtacgccgacgtacggtcgtaccgtccgcggtacaccgccgtaacggcctcccgtccccgttcgaccgtaccttccgg

SEQ ID NO: 357300 - DNA, 739 bp, Homo sapiens
  misc_feature: GZ8MTXP02G0TSS.22.36.D03.1.454.CMB.2.raw
  modified_base (271)..(271): a, c, t, g, unknown or other
  misc_feature (271)..(271): n is a, c, g, or t
tcagacatacgcgtcacgaccggtgctcgatttagctgcgtcacgatctctcttggggagctctgagagaggagcccagccctgggattttcaggttgttttcatttggtgatcaggactgaacagagagaactcaccatggagtttgggctgaagtggcttttgcttgtggtcttaattttaaaaggtgtcaagtgtgcggtgaaggtattggagtcgtgggggagtcgttggtacgacgggccggggggtcctgacactctcctgtgcngcctcgtgactcactagcagcagcaatcgccagtggtaggtttcggcccgccgaggtcctaccgggaagggggttaacggggttcgacggtaggggttcggggtaccggttagggggtagtttaggggaaaggttggacggttcgggtaccgaccaccgaacgaccgttacccggagtaaccggtcccgttccggggtaacggggaccgggggtcccctctttaccgacgttacctacgttacccgtaccgaaggtaacggtaaccgtaaccgttaaaacccgaaaaccgtacgtaaacggtacggtaacttacccgtggtaaaaccctaaagtcgtaaccacgttcccacgacgccgacccggaacggacccgtaccgggtcccgttacgttaccttcggtacggtaccgaacgtaacgttcctttacggtttacggttccgggacccggccggtacccgtaaccgg

SEQ ID NO: 357301 - DNA, 619 bp, Homo sapiens
  misc_feature: GZ8MTXP02HOAOC.22.36.D03.1.454.CMB.2.raw
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
  modified_base (377)..(377): a, c, t, g, unknown or other
  misc_feature (377)..(377): n is a, c, g, or t
  modified_base (390)..(390): a, c, t, g, unknown or other
  misc_feature (390)..(390): n is a, c, g, or t
  modified_base (393)..(393): a, c, t, g, unknown or other
  misc_feature (393)..(393): n is a, c, g, or t
  modified_base (407)..(407): a, c, t, g, unknown or other
  misc_feature (407)..(407): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcacatggagtttgggctgaagtggtcttttgcttgtggcttaagttttaaaaggtgtacaagtgtggcggtgaaggtattggagtcgtgggggaggtcttgggtacgagggccggggggtccctggacacgtctcctgtgcagtcctntaggtattcacngtcagcagctaangacagtgaggttcggccaccgngctacggaaggggtagggttgctagggtggtcgtgggattggaagtgaccgtggnacctagacaaacncgnaacgactccggggnggaccggctctcactcactcacgagacgtaacgtaacgtaaacgaaaacgacgtagtacgaactacgtacgaacgtaaagtacgaacacgaccgacgacgaccgacggaacgaccgtaccgtccgtactacgtacgacgtacgaaacgtaacgtaccgttacgttacggttcggaccggtaccgaccgtacgtaccggtacggaccggacgg

SEQ ID NO: 357302 - DNA, 629 bp, Homo sapiens
  misc_feature: GZ8MTXP02HROAU.22.36.D03.1.454.CMB.2.raw
  modified_base (324)..(324): a, c, t, g, unknown or other
  misc_feature (324)..(324): n is a, c, g, or t
  modified_base (361)..(361): a, c, t, g, unknown or other
  misc_feature (361)..(361): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggcccggggggtccctgacactctcctgtgcacgcctctggattcacagtcagcagcaatgccatgagttggccgcaggctccgaggggaagggttncgaggtgggtcgtcggggattggaagtgagtggtacnccacacaccgtacgcagtacctccggtaggacgggggcccgctttacgattccacttcctaccgaggaacgacgtaacttaaccgaaaaccacgacgtactaaatccgtagaactaaagtagtacacgtaccctacgaacgccgaccggaacggaccgaccgggcccttacgttacgtttcgtacgtacggacgtaaacgtacccttcgtttaaggttttccgggcccgtacggtacccgacgttaccgggcggggtaccgaaccggg

SEQ ID NO: 357303 - DNA, 564 bp, Homo sapiens
  misc_feature: GZ8MTXP02H5VZE.22.36.D03.1.454.CMB.2.raw
  modified_base (218)..(218): a, c, t, g, unknown or other
  misc_feature (218)..(218): n is a, c, g, or t
  modified_base (394)..(394): a, c, t, g, unknown or other
  misc_feature (394)..(394): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctatttccngcacgtgggaaccaacagtgactagttggtctttgctctgtctcctagtaccaacaacacccagaccccaaacccccatcatctattatgtcgtcactcgtccgcctacgaggacgtctctcatcgcttctcgacgtcctacctagtcctacgaccacgaccgccctaccctaacncttcctcgtcggcctacgtagttgacggtactcgttactacgttattctagtcttaacgttactttaaagtgccactcgtcgtcggttggttcgacggacgtacctaacgacgtaccggcctcgtacgtcacgtccgaagtcccaccgtccccgtcgtaccacgttcccg

SEQ ID NO: 357304 - DNA, 666 bp, Homo sapiens
  misc_feature: GZ8MTXP02HSHCY.22.36.D03.1.454.CMB.2.raw
  modified_base (304)..(304): a, c, t, g, unknown or other
  misc_feature (304)..(304): n is a, c, g, or t
  modified_base (453)..(453): a, c, t, g, unknown or other
  misc_feature (453)..(453): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggcttggtacgaggccggggggtccctgacactctcctgtgcagcctctggattcacagtcagcagcaatgccatgagttgggccnccaggctccgaggggagggttgcgaggtgggtcgtcggggatttgggaagtgagtgggtcgacccaacacaccgtacgcaagtacctccggtacggacgggggccctcttcgactcactcctaccgagacgacgaacttaccgaaaacncgaagtagaatctagactaaagtgtaaccacgcctacgacggccggaccggaacgggacccgaaccgggtcccgttaccgttaaccgtttcgtacggttacggtaaaccggtaaaaccgtacccgtttaccgtttaacggtttttccgggggccccggtaccggggtaccccggaccgtttaaccgggtccgggggtacccggtaacccgggg

SEQ ID NO: 357305 - DNA, 709 bp, Homo sapiens
  misc_feature: GZ8MTXP02IBCDD.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaacctcaccatggagtttgggctgaagtggcttttgcttgtggcttattttaaaaggtgtcaagtgtgcggtgaaggtattggagtcgtgggggaggcgttggtacgaggccggggggtccctgacgactctcctgtgcagcctctggattcacagtcaggcagcaatcgccatgaggtttcgggcccgcgaggcctccgaaggggtaggggttcgcgtagggtggggtcgtcggggtattgggaagtgagtggtcgaccacacactacgcgaaacgtcctacccgggtgaacgggggcccctctttaccacttcacttcccacccgaaggaagtaaccgtaacgtttaaaccccggaaaaaccaccgtaaggtaaggtaaaacttccgttacggaacctaaaagtttacggtaacaaccggccttaacgaacggcccgtacccgggaacggacccgacccggggtaccctttaccgtacgttttaccgtaggttaccggaaccggttaaaacggaccccttttagttaacggtttttcggggcccgccgggtaccgtacgtaccggtcgggggaccacccggggg

SEQ ID NO: 357306 - DNA, 684 bp, Homo sapiens
  misc_feature: GZ8MTXP02F7RKR.22.36.D03.1.454.CMB.2.raw
  modified_base (394)..(394): a, c, t, g, unknown or other
  misc_feature (394)..(394): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtcttttgactctgtctcctggtaccaacaacaccagaccaacccccatcatcattatggtctcactcgtcggccctcgagagtctcctcatcgtcttctcgacggtctaccaagtctaggccaaaccgccggccctaccctaaaccctntcccttacgtcgggtcccttacccgtaggtttcgaacggtacgacgttaccttaactttaacgttactcggtacttacggtttacccttttaaaagttaccgggtacctacccgtacgttcgttcgtttacggggttttcgggaccgggtaacggtcccgtaaccgtaaacgggttacccggaacccggtttcccgtaaccgggggttccaacccgggtaacccgtaaaccggggtccgttacccccgggtacccccccggttacggtccccttaacccgttttccccgg

SEQ ID NO: 357307 - DNA, 594 bp, Homo sapiens
  misc_feature: GZ8MTXP02FH021.22.36.D03.1.454.CMB.2.raw
  modified_base (403)..(403): a, c, t, g, unknown or other
  misc_feature (403)..(403): n is a, c, g, or t
  modified_base (428)..(428): a, c, t, g, unknown or other
  misc_feature (428)..(428): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtatggagtcgtgggggagcttggtacgaggccggggggtccctgacactctcctgtgcagcctctggattcacagtcagcagcaatgccatggagttcgggccgccgaggcctccggaggggaacggggttgcaggtggggtcgtcggggatttgggaagtgagtggtcgcctacaccaacgtacgcagtactccggnggacgggccgtcgttcactcatccnccagtaacgacgacttaacccgaaaactacagtagaatacgtacgataaatcgtaacacgcctcgaacgccgaccggacggaccgacgggtccctacgttaccgttctcggtacgacgtaaacgtcccttacgttacggtttcggcccggtccggacccgtaaccg

SEQ ID NO: 357308 - DNA, 588 bp, Homo sapiens
  misc_feature: GZ8MTXP02FGIGF.22.36.D03.1.454.CMB.2.raw
  modified_base (217)..(217): a, c, t, g, unknown or other
  misc_feature (217)..(217): n is a, c, g, or t
  modified_base (331)..(331): a, c, t, g, unknown or other
  misc_feature (331)..(331): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctggtaccaacaacacccaggccaaaccccccaatcatcatttatgtgtcactcgcgcctcaggagtctcncatcgcttactcacggctccaagtctggaccaacacggccctaccctaaccatcctctggctcctagttcgagacgtagtctacttatactgtctagtttacctttaaagtaggtccacctacttcgttcgttcgggtttcggcggtacggacgaccgtaaggtccgtacccggttccgttacggggtccacggtaccccgaaacggtccgtcccggtccccccttcgggtaccctaaccgttcccgtttaccccgg

SEQ ID NO: 357309 - DNA, 759 bp, Homo sapiens
  misc_feature: GZ8MTXP02HNCNG.22.36.D03.1.454.CMB.2.raw
  modified_base (286)..(286): a, c, t, g, unknown or other
  misc_feature (286)..(286): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggcttaattttaaaaggtgtcaagtgtggcggtgaaggtattggagtcgtgggggaggcgttggtacgacgggcccggggggtccctgaccactctccgtgtgcagcctcgtggacttcacngtcaggacagacaatcgaccagtggtacggtttcggggtccccgaccgaggcccgtaccggtaaaggggggtaaggggtttcgaccggtaggggttcggggtacggtacgggggtaagtttaggggaaaggtggtaggttcgggtcgacccaaccaaccgtaccgtacgccgaaacgtacccggtccgggtagggacccgggggccctacgtttaccgacgttccaaacgttcccgtaccgaaggaaccgtaaaccgtaacgttaaacccgaaaaacgtccgtaaagttagaaaccttcgtaagaacttaaaagtcgtaaccaacgtccaacgaccgaccggacggacggaccgtaccggtcccgttactaaccggttcacgttaccggaaaccgtaaccgtaccttccgtttaaggtttccccgggaccgcccgggtacctaacccggtcggtacccgggacgtaacccggg

SEQ ID NO: 357310 - DNA, 676 bp, Homo sapiens
  misc_feature: GZ8MTXP02HCJ3N.22.36.D03.1.454.CMB.2.raw
  modified_base (219)..(219): a, c, t, g, unknown or other
  misc_feature (219)..(219): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaaccaacagtgactagttggtctttgactctgtctctgtaaccaacaacacccagaccccaaacccccatcatctattatggtctcacgtcgtccgccctacgagactctcctcactcgtcttctcgacggtcctaccgaagtccgtacgaccaaccgcccggtacccctaccctaaacctacttcccgtcggtcggtccttaccgtacggtttacggaacgtacggtacttaccgttaactttacttacgtcgttacttaaccgttttaacgtttaaagttaccggtacctacccgttaacgttcccgtttcggggtttcgggttttacgggaccggtacggtaccgaaaccggtaacggttaccggtacccgttccgttacccggtacgtaccggcccggtaacgtccgttcccggtacccccggtcgtccctacccgtttccccg

SEQ ID NO: 357311 - DNA, 682 bp, Homo sapiens
  misc_feature: GZ8MTXP02H6Y39.22.36.D03.1.454.CMB.2.raw
  modified_base (362)..(362): a, c, t, g, unknown or other
  misc_feature (362)..(362): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaacccaacagtgactagtttgggtcttttgactctgtctcctggtaaccaacaaccacccgacggaccccaaaccccccactcactcattatgtgtcactcgtcgccctgacggactctctctactcgtcttcncgacggtcctacctaagtcctacggaccaaccgaccgtccctacccctaaccactcctcgtcggggtcccttaccgttaggtttacgaacgggtaccgttacgttccttaaactttacttaccgtacggtacttacgtttacctttaaagtaccgtccgtaccctacgttccgttcgggtttcggtttacgggaccggtacgggaccgtaaccgggtaaacgtccggtaccccggttaccgtccggtaaccgtaccggtaaccccgtaaacggtcccgtaccccgggtccccctccggggtaccctaacctttcccccgg

SEQ ID NO: 357312 - DNA, 654 bp, Homo sapiens
  misc_feature: GZ8MTXP02G0Y54.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggcttggtacgaggccggggggtccctgacactctcctgtgcagcctctggattcacagtcagcagcaatcgccagtgaggttgggtcccgccgaggcgtccggaaggggtaaggggttgcgtaggtgggtctcggaaggggtattagggaagtggagttgggtcgacccacgaaccaccgtacgccaaggtacccgtccggtgggaacgggggccctacttaccgactactactcctaccgagacgacgaacttaaccgaaaacaacgaagtaacgtaatacgtacgtaactaaagtacgtaacgacgtacccgtacgacgccggaccggaacggaccgaccggtccgtacgtactcgtcgtacgacgtaaacgtaccgttacgttaacggttttcgggaccggtaccggaccgtacgtaccggtacgggacccgg

SEQ ID NO: 357313 - DNA, 663 bp, Homo sapiens
  misc_feature: GZ8MTXP02FWOC0.22.36.D03.1.454.CMB.2.raw
  modified_base (337)..(337): a, c, t, g, unknown or other
  misc_feature (337)..(337): n is a, c, g, or t
  modified_base (453)..(453): a, c, t, g, unknown or other
  misc_feature (453)..(453): n is a, c, g, or t
  modified_base (479)..(479): a, c, t, g, unknown or other
  misc_feature (479)..(479): n is a, c, g, or t
  modified_base (515)..(515): a, c, t, g, unknown or other
  misc_feature (515)..(515): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggtcgttgggtacgagggccgggggggtccctggaccactctcctgtgcagcctctggattcacagtcagcagcaatgccatgaggttcggtccgcgaggctccgaggggaaggggttcncgagggttggcggtcggggtagttgggaaagtggtacgtgggtcgaccaccaacgaccgtaccgcgaacgaccgttaccgggaggaccgggggaccctcttacgactcaattcccncgaagagaccgacttaaccgaaaacngtaatgaaactcctaggaactaaagttctaacgacnccctacgcggaccgacggacgaccggaccggtcccgttactaccgtttcgacgtacggtaacgaaaccgttaccttcggttttaaccggtttcggggaccccggtcggaccccggtacgtaccgggtacgggggaccccttaccgggg

SEQ ID NO: 357314 - DNA, 692 bp, Homo sapiens
  misc_feature: GZ8MTXP02IRVOK.22.36.D03.1.454.CMB.2.raw
  modified_base (444)..(444): a, c, t, g, unknown or other
  misc_feature (444)..(444): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggtcttaagttttaaaaggtgtcaagtgtgcggtgaaggtattggagtcgtggggagcttggtacgaggccggggggtcctgacactctcctgtcgcacgcctcgtggattcacagtcagcagcaatcgccagtcggacggtttcgggtcccgaccgaggtccgtacccggagggggtaaggggtttcgcggtagggttcggggtcgtcggggtagttgggaaagtgacggtggcgaccacacacctacgcgaagtccgccggtagggacggggtccctnttacacgtacactcctacgagaacgtacgtaccttaaaccgaaaacacgtacgtacgtaaacgtctagaactaaagtaccgtacaccgtcccgtacaccgggaccgaaccggacggaacccgtaccggtcccgttaccgttacttccgtacggttaaccgacgtaaaacgttacccgttcgttttaacggtttcccggggacccgtacgggtacccgtaccggtaccggtcggggacccgtaacgggg

SEQ ID NO: 357315 - DNA, 734 bp, Homo sapiens
  misc_feature: GZ8MTXP02I2EQG.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggtcttaattttaaaaggtgtcaagtgtgcggtgaaggtattggagtcgtgggggagtcgttgggtacgagggccggggggtccctgaccactctcctgtgcagcctgtgattcacagtcagcagcaatcgcctatggtacggttcggtcccgccgaaggtcctccggaaggggtaggggttgaccgtagggtcggggtcgtggggtattagggaagtgagtgtacgccacgacaccgtacgcgacgtacgtccgggtagggacggggtcccgtcttcgatacctacgtaccctaccgaaaggtaacgaaccgttaaacgttaacccgaaaaaaccgtaccgtaaggttaacggtaaatcccgttaaggaaaccttaaaagtcgttaaacgaccgacctaccgaaacgcccgggaacccgggaaacggtacccgaacccggggtccccggttacttaaccggttccgttaacgggtacggaaaacccgtaaaacgttcccccgtttaagtttttaccggggtttacccgggacccgggttcccggtaacccggtttaacccggg

SEQ ID NO: 357316 - DNA, 624 bp, Homo sapiens
  misc_feature: GZ8MTXP02IDT5B.22.36.D03.1.454.CMB.2.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctggtaccaaacaacacccaggccaaaccccccactcatcatttatggtgtcactcgtccgccctcaggagtctcctcatcgcttctcaggctccaagtcctggcctaacgaccgccctaccctaacactctctcggctccagtttcgaggtacagtcttaactttaacttactcgtacttacggtttaccttttaaaaagttcgggactaccctaacgttccttcgggtttacgggtttttcgggcggtaaacggtccgaccggtaaaccggttagtaaacccggtccgtttccgtaccgttaccgaacccggttaaacggaccgttcgacccccgttcccggttccgtaccggtttccccg

SEQ ID NO: 357317 - DNA, 628 bp, Homo sapiens
  misc_feature: GZ8MTXP02IC7BC.22.36.D03.1.454.CMB.2.raw
  modified_base (306)..(306): a, c, t, g, unknown or other
  misc_feature (306)..(306): n is a, c, g, or t
  modified_base (459)..(459): a, c, t, g, unknown or other
  misc_feature (459)..(459): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcgttggtacagggccggggggtccctgacactctcctgtgcacgcctctggattcacagtcagcagcaatgcatgaggtttcgggcccnccgaggctaccggaggggtaaggggttgcgtagggtgggtcgtcggggtattggggaagtgagtggtcgaccacacactacgcagacctccgggtgacgggggcctcttacagtcactctccagacgtacgacttaaccgaaaacacgagtanaatctagactaaatcgtacacgtccacgacgcgaccggaggaccgaccgggtcccttacttaccgttcgtcgtacgaaccgtaaaacgtaccctttacgtttaacgttttccggggacccgtaccggtacccggtaaccgtttaccgggccggggtacccgacccgggg

SEQ ID NO: 357318 - DNA, 649 bp, Homo sapiens
  misc_feature: GZ8MTXP02I0NT6.22.36.D03.1.454.CMB.2.raw
  modified_base (235)..(235): a, c, t, g, unknown or other
  misc_feature (235)..(235): n is a, c, g, or t
  modified_base (265)..(265): a, c, t, g, unknown or other
  misc_feature (265)..(265): n is a, c, g, or t
  modified_base (428)..(428): a, c, t, g, unknown or other
  misc_feature (428)..(428): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggacccaanagtgacagttggtctttgactctgtctccnggtaaccaacaaccaccacggaccccaaacccccactctactctatttactggtcgtactactcggtccgcccctacgaggtacgtctcctcagttccgtctttactcgacgtcctccgaaagtcctagggacctaaccgaccgtcccctaccccgtaaaccnttccgtcgtcgggtccttccgtagtttggaacgggaccgtacgttacttacttaacttacgcgtaccgtagtttaccctttaaaagtccggtactaccctacttcgttacgggttacggtttcggacggtacggtcaaccggtaaggtcccgaccgttcccgtacggtccgacgaacccgtacggtccctaccgtcccccggtcggtacctcctttcccgg

SEQ ID NO: 357319 - DNA, 644 bp, Homo sapiens
  misc_feature: GZ8MTXP02G4DAQ.22.36.D03.1.454.CMB.2.raw
  modified_base (310)..(310): a, c, t, g, unknown or other
  misc_feature (310)..(310): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccggggggtcctgacactctcctgtgcagcctcgtggattcacagtcagcagcaatgccatggagttcgggtccnccaggctccgaggggtagggttgcgaggtgggtcgtcggggattgggaagtgagtgggtcgaccacaccaactaaccacgaacgaccgtccggtagggacggggcccgtcttacactcaacttccaccgaagaacgaaccgtaacttaaccgaaaaaacacgtaaaggtagtaaatacctaggaacctaaaagttacgtaacgacgccacgacgaccgaccggaacggacccgaaccggtcccgtaccttaaccgttccgtacggtacgaaccgtaaaacgtacccgttacgtttacggttttccgggacccggtccgggtacccggtaaccgg

SEQ ID NO: 357320 - DNA, 623 bp, Homo sapiens
  misc_feature: GZ8MTXP02GMOML.22.36.D03.1.454.CMB.2.raw
  modified_base (307)..(307): a, c, t, g, unknown or other
  misc_feature (307)..(307): n is a, c, g, or t
  modified_base (408)..(408): a, c, t, g, unknown or other
  misc_feature (408)..(408): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggcttgggtacgaggccgggggggtccctgaccactctcctgtgcagccctctggattcacagtcagcagcaatgaccatgagtggtccncaggctccgaggggaagggttgcgaggtgggtcgtcggggattgggaagtggagtggtgacccagaccactacgcacgaccgtccggtggacgggggtccncgttcactcactctaccagacgacgactaccgaaacacagtagaatcacgactaaagtacgtacacgcctaccgacgaccggaccggacggaccgaccggtacccgtaccgtacgtttccgtcgtacgaaccggtaaaccgtaccttaccgttaacggttttccgggcccggtccggacccggtaccgtaccggtacggggacccggtaccgggg

SEQ ID NO: 357321 - DNA, 794 bp, Homo sapiens
  misc_feature: GZ8MTXP02FZBW7.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttggtacgaggccggggggtccctggacactctcctgtgcagcctctggattcacagtcagcagcaatcgccatggaggttcgggtcccgccgaggccgtacggaggggtaaggggttgcgtagggtcggggtcggtcggggattaggggaagtggagtgggtcgaccgactacgacctacggcgacgtaccgtccgggtggaccgggggtcctcgttacacgtcaacgtcctaccgaggaaacgtaccgaacgtttaaacccggaaaaacgtaccgtaaagtacggtaaacttaccgtaacgaacgtaaaacgttacggttaaccgaccggtacccccgttacgaaccgggtacccccgggaaccggggtaacccggggtaacccggaaccccgggggttacccccgtttaccggtttaaacccgtttcccggttaagggttaaacccgggtaaccgggttaaaaacccgtttaccccgtttacggtttttaacggttttcccgggggaccccggtacccggggtacccgtaccggtacccggggttaccgggggaccccggtaacccggggg

SEQ ID NO: 357322 - DNA, 619 bp, Homo sapiens
  misc_feature: GZ8MTXP02FM98R.22.36.D03.1.454.CMB.2.raw
  modified_base (308)..(308): a, c, t, g, unknown or other
  misc_feature (308)..(308): n is a, c, g, or t
  modified_base (403)..(403): a, c, t, g, unknown or other
  misc_feature (403)..(403): n is a, c, g, or t
  modified_base (460)..(460): a, c, t, g, unknown or other
  misc_feature (460)..(460): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggctaattttaaaaaggtgtcaagtgtgcggtgaaggtattggagtcgtgggggagtcgttggtacgaggccggggggtccctgacactctcctgtgcagcctctggattcacgagtcagcagcaatcgccatgagtgggtccncgaggctcgagggtagggtgcgaggtgggtcgtcggggatggaagtgatggtcgacacacacgtacgcgacgacgtccggaggaccgggggtccnccttgactctaactctaccgagacgacgacttaaccgaaaacacgtacgagtaaacncgtagaacaaatcgtaacacgtccagacgccggacgacggaccgtacgggcccttactaccgttcgtcggtacgaaacgtaaaccgtacctttcgttaacggtttcgggcccgtaccggggtacccgtaccgttaaccgggccggggaccgtacccggg

SEQ ID NO: 357323 - DNA, 589 bp, Homo sapiens
  misc_feature: GZ8MTXP02GLYMV.22.36.D03.1.454.CMB.2.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcacgtgggaaccaangtgactagttgggtcttttgactctgtctcctggtaaccaacaaccacccgacgaccccaaaccccccatcactctatttnggtntcactcgcgccngaggactctctcatcgtcttctcgagtcctaccagtcgtagccaacgccgccctaccacctatcctcgtcggcctaccgtagtttcggaaggtacgtacttaccttaacttacttacgtcgtacttaacgtttacctttaaaagtcggcctacctacttccgttggtttcgggtttcgggacggtacgtaccgacggtaacgtcgaccgttccgtacggtcacgaaccgagtcctccgtcccctggtcctcttcccg

SEQ ID NO: 357324 - DNA, 641 bp, Homo sapiens
  misc_feature: GZ8MTXP02J250J.22.36.D03.1.454.CMB.2.raw
  modified_base (267)..(267): a, c, t, g, unknown or other
  misc_feature (267)..(267): n is a, c, g, or t
  modified_base (399)..(399): a, c, t, g, unknown or other
  misc_feature (399)..(399): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggcttggtacgaggccggggggtccctggacactctcctgtgcagcctntggattcacagtcagcagcaatgccagtgagttcgggtcccgcgaggccgtaccgaggggtaggggtgcgtaggtcgggtcgtcggggattggaagtgactggtcgccacacactacgcgagaccgtccggnggacggggccctcttcgactccactcctaccgagaacgacgtactaaccgaaaacacgagtacaactctacgacaaagtacgtaccgaacgtccacgacgaccggaccggaacggacccgacggtccgttaccgtacttcgtacggtacgaaaccgtaaccgtaccgttaccgtttaacggttttcccgggacccggtaccggtacccgtaaccgttaccggccggggaccgtaacccgggg

SEQ ID NO: 357325 - DNA, 616 bp, Homo sapiens
  misc_feature: GZ8MTXP02F5MM4.22.36.D03.1.454.CMB.2.raw
  modified_base (251)..(251): a, c, t, g, unknown or other
  misc_feature (251)..(251): n is a, c, g, or t
  modified_base (292)..(292): a, c, t, g, unknown or other
  misc_feature (292)..(292): n is a, c, g, or t
  modified_base (615)..(615): a, c, t, g, unknown or other
  misc_feature (615)..(615): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaagggttgcagtgggtctcggggattggaagtgatggtgccacacactacgcagactccgtggaggggccgcttcatcatctccagagacgattaccgaaaacncagtagaatctgacaaatgtacacgcctcagcgcgaggacncgccgtctacttctgtgacgaaacgtacctacgtttagtttttacggggccgtccgggtccgtacccgttaacggtcggggccgacggggccacccggtcgggtccgacccgtcttccttccgacgtccctaccaacccgaaacggggccccacgttcccggtcccttcccccgtggccccgtccccgtcggccctccgacgggcaccgacccgtcgacgagccacgcgccggcccgtgggcctgccgtaggtacgaacggtaccttcgttaccacgtcgttacgtcgtcgtggaggccggcgtcggacgacgggcacgtagng

SEQ ID NO: 357326 - DNA, 682 bp, Homo sapiens
  misc_feature: GZ8MTXP02HSWDC.22.36.D03.1.454.CMB.2.raw
  modified_base (334)..(334): a, c, t, g, unknown or other
  misc_feature (334)..(334): n is a, c, g, or t
  modified_base (337)..(337): a, c, t, g, unknown or other
  misc_feature (337)..(337): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttggctgaagtggtcttttgcttgtggcttaattttaaaaggtgtcaagtgtgcggtgaaggtattggagtcgtgggggaggtcgttgggtacgagggcccgggggggttccctggacctaccgtccttcccgtgtcgcacgtcctcgtggacttcactagcagcagcaatgccatggtaggttcggccncgnggccgtaccggaggggtaggggttgacgtagggttcgggtcggtacggggtagtttagggaagtgtaggttggcgacccacgactaacctacggaccaacgggtaccgtcgggtacggggccggggtcccgtacttacgaactcctaacttcccgtaccgaggtaaccgaaccgtaaccttaaaccgaaaacgacgtaagtacggtaatccgtagaaacctaaagtacgtaacgacgccgtaacgacggacccgacggaacgaccggaaccggtcccttacgttactcgtagtaccgagtaaaaccgtcgttacgtttacgtcggtaccgcggtacccgtaacgg

SEQ ID NO: 357327 - DNA, 620 bp, Homo sapiens
  misc_feature: GZ8MTXP02HAUDN.22.36.D03.1.454.CMB.2.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (357)..(357): a, c, t, g, unknown or other
  misc_feature (357)..(357): n is a, c, g, or t
  modified_base (428)..(428): a, c, t, g, unknown or other
  misc_feature (428)..(428): n is a, c, g, or t
tcagacatacgcgtcacgaccggtgctcgatttagctgcgtcacgatctctcttggggtggggtcccaggaggcagcgctctcgggacgtctccaccatggcctgggctctgctattcctcaccttcctcactcagggcacgagggtcctgggcccagtctgccctgacccagcctgcctcgtgtctggatcatctggacagtcgatcagtctatttccngcacgtaggaccaangtgactagttcggttctttgacttctcgtctcgtacgtaaccaacaaccacccacgaccccaaacccccatcatctattagtcggtctctacgtccggtccgtacctgaacgtctccttacnccgtactcgtctctacgaacggtcctaccgtagtctacggacctaaccgtcccgtaccctacctaaccgtntccgtacgtcggtctacgttagtcggaacgtacgttactacgttacttactcgtacgtacgttacgtttaacttaaggtcgtcctacctacgtttcggttcggttcgggttacgacggtaacgcgacgttagccgttacgtccgtacgccacgtaccgaacgtcctccgccgtacgtcctacgtccgtcccg

SEQ ID NO: 357328 - DNA, 603 bp, Homo sapiens
  misc_feature: GZ8MTXP02HSYFS.22.36.D03.1.454.CMB.2.raw
  modified_base (374)..(374): a, c, t, g, unknown or other
  misc_feature (374)..(374): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttggctgaagtggcttttgcttgtggctaattttaaaggtgtcaagtgtgcggtgaaggtattggagtcgtgggggagcttggtacaggccggggggtcctgacactctcctgtgcagcctcgtggacttcacagtcagcagcaatcgcatgagttcggccgccgaggcctaccggaggggtaggggttgcgtaggtgggtcgtcggggattagggaagtgagtgggtcncctacacacgtacgacgacgtccgtcggtgggacgggccgtcttcagtcactcctaccgaagacgaaccgtacgttaacccgaaaacgacagtacgtaatcgtagactaaagttcgtaacacgcctacgacggaccgacccggacgtaccgaccggcccgtacttaccttcgtacgtacgacgaaaacgtccttacgttacgtttccgggacccgtcggacctaaccgg

SEQ ID NO: 357329 - DNA, 638 bp, Homo sapiens
  misc_feature: GZ8MTXP02IVTN4.22.36.D03.1.454.CMB.2.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (293)..(293): a, c, t, g, unknown or other
  misc_feature (293)..(293): n is a, c, g, or t
  modified_base (319)..(319): a, c, t, g, unknown or other
  misc_feature (319)..(319): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggacccaanagtgacattgggtctttgactctgtactctgtaccaacaacaccacgaccaaacccccancatcattatgtgtcactcgcgccctnagactctctcatcgcttctcagctcatctagcaacacgcctaccaacntctcgnggtctacgtagtttcgaggtacgtacgtcttaacgttacttacttacgtaccttacggtttaacccttttaaaagtaccgggtcctaccttaacgttccctttacgggtttacgggttttccgggacggggttaaccggccggtaaaccggtaaacggttaccggtaacccggttacccgttccgggtaccgtaaccggtaacccggaaaaccggtccgttccccggtaacccccgttccgggttaacctacccgttttccccgg

SEQ ID NO: 357330 - DNA, 690 bp, Homo sapiens
  misc_feature: GZ8MTXP02GT77O.22.36.D03.1.454.CMB.2.raw
  modified_base (264)..(264): a, c, t, g, unknown or other
  misc_feature (264)..(264): n is a, c, g, or t
  modified_base (325)..(325): a, c, t, g, unknown or other
  misc_feature (325)..(325): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggcttattttaaaaggtgtcaagtgtgcggtgaaggtattggagtcgtgggggagcttggtacgacggcccggggggtcctggactacgtctcctgtgcngcctcgtggtacttcactagtcagccagacaatcgacctagtggtacggttcgggtccccnccgagggtccctaccggaaggggtaagggttcgcgtagggtgggtcggtggggtagtaggagtgagtggtcgaccacgacacgtacgcgacgtaccgtccgggtggaccgggggcctcttcgactcgtactcctaccgagacgaacgtaacttaaccgaaaactacgtaagtagtaaacgttcgagaaccgtaaagtacgtaccgacgtacccgacgacggccgacccgggaacgaaccccgccggtacccgttaccttacgtacgttacggtaacgaaccggtaaaacgttcccgttacgtttacgggtttaaccggcccggtaccggtacccgtaaccgtccgggaccgggaccgtacccggg

SEQ ID NO: 357331 - DNA, 595 bp, Homo sapiens
  misc_feature: GZ8MTXP02H3TVK.22.36.D03.1.454.CMB.2.raw
  modified_base (218)..(218): a, c, t, g, unknown or other
  misc_feature (218)..(218): n is a, c, g, or t
  modified_base (302)..(302): a, c, t, g, unknown or other
  misc_feature (302)..(302): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggacccaacagtgactattgggtctttgactctgtctctggtaccacacaccagccaacccccatcatcattatggtntcactcgtcggccctcaggatctctcatcgcttctccaggtcctaccaacgtctggacaaccgacggtccctaccctaacactcgtcgtgggcctccgtagtttcgacgtacgtatccttacttaattacctggtcttacgtttacctttaaagttcggacgtcctactcgtcgtttcgggtttcggacgggtaggacctaccgggtaacgtacggtacccgttcccgtccgggttaccaacgggtccccgtaacggccgtaccgtcccccgtcgggtcctaccggtttcccg

SEQ ID NO: 357332 - DNA, 625 bp, Homo sapiens
  misc_feature: GZ8MTXP02ID9F3.22.36.D03.1.454.CMB.2.raw
  modified_base (303)..(303): a, c, t, g, unknown or other
  misc_feature (303)..(303): n is a, c, g, or t
  modified_base (326)..(326): a, c, t, g, unknown or other
  misc_feature (326)..(326): n is a, c, g, or t
  modified_base (408)..(408): a, c, t, g, unknown or other
  misc_feature (408)..(408): n is a, c, g, or t
  modified_base (445)..(445): a, c, t, g, unknown or other
  misc_feature (445)..(445): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaaggtgtcaagtgtgcggtgaaggtattggagtcgtgggggaggcttggtacgaggccggggggtcctgacactctcctgtgcagcctctggattcacagtcagcagcaatgccatgagttgggtccncaggctccgaggggaaggggttncgtaggtgggtcgtcgggggtattgggaaagtgacgtgggtcgccacacaccgtacgcgagacctccgggtgacgggggccncgttcaatcatctccagagacgtacttaccgaaaacncagtgaaatcgtagactaaaatcgttacaacgtccctacgaacgccgaccggacggaccgaccgggtacccgtcgttaccttcgtcggtacggaacgtaaacgtaccctttcgttaacggtttttccggggaccggtcccggtacccgtacggtaccggtcgggggacccgtaaccgggg

SEQ ID NO: 357333 - DNA, 552 bp, Homo sapiens
  misc_feature: GZ8MTXP02F92NL.22.36.D03.1.454.CMB.2.raw
  modified_base (468)..(468): a, c, t, g, unknown or other
  misc_feature (468)..(468): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccgggggggtcctgacactctcctgtgcagcctctggattcacagtcagcagcaatgccatgagttgggtccgcaggctccgaggggaaggggttgcgaggtgggtcgtcggggattgggaagtgagtggtcgaccacacactacgcagacctccggtaggacggggccgtcttcatcatctaccagagacgattacccgaaaacacagtagaaatctagacaaatgtaacagtaccncaagcgcgacggacacggccgtactactctgtcgacgaacgacctcttagtttcggccgtcggccgacgtacgcgggcgacggg

SEQ ID NO: 357334 - DNA, 583 bp, Homo sapiens
  misc_feature: GZ8MTXP02IFK2M.22.36.D03.1.454.CMB.2.raw
  modified_base (315)..(315): a, c, t, g, unknown or other
  misc_feature (315)..(315): n is a, c, g, or t
  modified_base (381)..(381): a, c, t, g, unknown or other
  misc_feature (381)..(381): n is a, c, g, or t
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
tcagacatacgcgtcacgaccggtgctcgatttagctgcgtcacgatctctcttggggaggtctgagagaggagcccagccctgggattttcaggtgttttcatttggtgatcaggactgaacagagagaactcaccatggagtttgggctgaagtggtcttttgcttgtggcttattttaaaaggtgtcaagtgtgcggtgaaggtatggagtcgtgggggagcgttggtacgacgggccggggggtcctgacactctcctgtgcagcctctggattcacagtccagcagtcaatgccagtgagtttgggcccncgaggctccgaggggaaggggttgcgaggtgggtctcggggtattgggaagtgagtggtagccacncgacgtacgacagtccgtcgtgggacggggccctgtcatcatcctcagacgacaatacccgaaanacagtanatcngactaaatgtacgactcacgacgcgaccgacggtacgaccggtccgtacgttactctcggtacgaccgaaaacgtcccttagtttaacggttttcgggacccggtccggtaccgtactaaccgggg

SEQ ID NO: 357335 - DNA, 686 bp, Homo sapiens
  misc_feature: GZ8MTXP02I0I5E.22.36.D03.1.454.CMB.2.raw
  modified_base (278)..(278): a, c, t, g, unknown or other
  misc_feature (278)..(278): n is a, c, g, or t
  modified_base (513)..(513): a, c, t, g, unknown or other
  misc_feature (513)..(513): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaggtgtcaagtgtgcggtgaaggtattggagtcgtgggggaggcttggtacgaggccgggggtccctgacactctcctgtgcagcctctggattcanagtcagcacgcaatcgccatggagttcggggtcccgaccgaggccgtcccggaaggggtaaggggtttcgcggtagggttcggggtcgttacgggggacgttaggggaagtggtagttgggtccgaccctacgaccgaaccgtacgaccaacgtacccgtccggtagggacggggtcccgtcttaccgtaactccaagttccctccgaaggtacgaacgtactaaaccgaaaacncgtaaagtacgtaaatctagaacctaaaagtcgtaaacacggtaccctacggaacgccggacccggaaggacccgaacccgggtccttacgttaaccgttcgtacggtacgaaccgtaaaacgttccccttaggtttacggtttaccggggcccgtacggtacccggttacgg

SEQ ID NO: 357336 - DNA, 574 bp, Homo sapiens
  misc_feature: GZ8MTXP02FNHMD.22.36.D03.1.454.CMB.2.raw
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (320)..(320): a, c, t, g, unknown or other
  misc_feature (320)..(320): n is a, c, g, or t
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactggaccaacagtgactagttgggtcttttgactctgtctcctgtaccaacacaccagaccaaaccccccancatcattangtgtcactcgtcggcctnaggactctcctcatcgtctctcgnggtcctccaagtctgaccaacnccggccctaccctaacctactctcgtggcctcgagtttgacggacgagtctacttattactgtctagtttaacctttaaagttcgcgtcctacttacttcggttggttttccggacggtacggtctagtacgaaacgttcggtacccgttccgtcggtaccaaccggtacccacggtcctacccggccccccgttcggtacctacccg

SEQ ID NO: 357337 - DNA, 678 bp, Homo sapiens
  misc_feature: GZ8MTXP02FZDPN.22.36.D03.1.454.CMB.2.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (325)..(325): a, c, t, g, unknown or other
  misc_feature (325)..(325): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
tcagacatacgcgtcacgaccggtgctcgatttagctgcgtcacgatctctattggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaacngtgactagttggttctttgactctgtctctgtaccaacaacaccacgaccaaacccccatcatcatttngtntcacgtcgcgccctgagntcnctcatctcttcncgagtcctaccaagtcgtacgaccaacgaccgtacccctaccctaaaccacttccgtcgtcgggtcccttaccggtacggtttaggaaacggtaccggttaacttccgttaaaaccgttttagtttaaccctacggttaccccgtttaaacgtttttaaacccgtttaaaaggtttaccgggccctacccttaacggtttccgttccgggtttacgggttttcgggacgggtacggcccgtaaacggtacggtaccgttacccgtcccgtacggtccgaaccgaacccggtaacggtcccgtacccgcccccggttacgtacccgttacctttccccg

SEQ ID NO: 357338 - DNA, 631 bp, Homo sapiens
  misc_feature: GZ8MTXP02FJPDN.22.36.D03.1.454.CMB.2.raw
  modified_base (304)..(304): a, c, t, g, unknown or other
  misc_feature (304)..(304): n is a, c, g, or t
  modified_base (402)..(402): a, c, t, g, unknown or other
  misc_feature (402)..(402): n is a, c, g, or t
  modified_base (442)..(442): a, c, t, g, unknown or other
  misc_feature (442)..(442): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggcccgggggggtcctgacactctcctgtgcagcctctggattcacagtcagcagcaatgccatgagttgggtccncgaggctccgaggggaacggggttgcgaggtgggtcgtcggggattgggaagtgagtggtgccacacacctacgcagaccgtccgtgggacggggccncgttcatcactcctacgagacgaacgacttaccgaaaacncaagtgaaatcagacaaatgtaacgagccctacgacgccggaccggaacggaccgaaccggggccccgttacgttaacccgtttcgttacggtcggtaaccgtaaaacgtcccttaacgttttacggttttcgggggccccgtacggggtccccgtaacgtttaccggcgggggtcccgaacccggggg

SEQ ID NO: 357339 - DNA, 681 bp, Homo sapiens
  misc_feature: GZ8MTXP02F4LTD.22.36.D03.1.454.CMB.2.raw
  modified_base (235)..(235): a, c, t, g, unknown or other
  misc_feature (235)..(235): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtcctggatcatctggacagtcgatcagctatttcctgcacgtgggaccaanagtgactagttgggtctttgactctgtctccgtgtaccaacacacccacgaccccaaaccccccatcactactatttagtggtcgtactaccgtccgtccggtccctagagggtacgttcctccctacacttccgtcctttcgaccgtacggtccttaccgaaagttccgtacggacccaaaccgtcccggtccccttaaacccctaacctacgttcccgtccgtacgggtccctaccgtaggtttacggaacgggtacgtacgttactttaaccgttaattccgtacgtactttaccgtttaaccgtttaaagttccggacctccgtacgtttcggtggtttcgggtttccggacggtacgtaccgaaccggtaacggtcgtacccgttcgtaccggcaacgaacccgtacgtccgtccccgtccccgtcgtaccacctttcccg

SEQ ID NO: 357340 - DNA, 675 bp, Homo sapiens
  misc_feature: GZ8MTXP02HX4P1.22.36.D03.1.454.CMB.2.raw
  modified_base (279)..(279): a, c, t, g, unknown or other
  misc_feature (279)..(279): n is a, c, g, or t
  modified_base (291)..(291): a, c, t, g, unknown or other
  misc_feature (291)..(291): n is a, c, g, or t
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
  modified_base (349)..(349): a, c, t, g, unknown or other
  misc_feature (349)..(349): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtagaagtattggagtcgtgggggagcgttggtacgagggccggggggtccctgacgactctcctgtgcagcctctggtattcaacngtcagcagcaangcatgagttggccgcgagctcgaagggagggttncgagtgggtcgngggagtggaagngagtggcgccacgtacacgttacgcaagtacctcccggtagggacggggcccgtctttaccgacttcgaacttcccgtacccgaaggaacggtaacgtaaaccgttaacccggaaaaaacctaaccgaagttacggaaacttaccgttaggaacctaaaagtacggttaaactacggaccctacgaaccgccgaccgggaacggtaccgacggcccgttactaaccgttctagtacggaacgtaaaacgacccgttaactttacggttttccgggcccggtacccggtaccgtaccgtaaccggtccgggggaccgaacccggggg

SEQ ID NO: 357341 - DNA, 702 bp, Homo sapiens
  misc_feature: GZ8MTXP02F0KC0.22.36.D03.1.454.CMB.2.raw
  modified_base (366)..(366): a, c, t, g, unknown or other
  misc_feature (366)..(366): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggcttaattttaaaaggtgtcaagtgtgcggtgaaggtattggagtcgtgggggagcgttggtacacgggccggggggtcctgacactctcctgtgcagcctctggattcacagtcagcagcaatcgccatgagttgggtcctcgaggcctacgaggggtagggttgcgaggtgggtcgtggggtatgggagtgagtggacnccaacactacgacgcgacgccgtaccggtagggaccggggtccactttcacgttacctacgttaccacccgaagggtaaccaccgggttaaaccttaaaccccggaaaaagttccgtaaaagttggtaaaccttaccgtagtaaacccgtaaaagttcccgtaaaccgacgggttcccccaggaaccgggcccggaaccggaacggtaacccgtccgggaccccgtttgttaaccgttccggtaacggtaacggaaccgtaaaacgttccgttacgttttacggttcggggaccccgtcgtaacccgtacggtcggtaccgggccgttacccgggg

SEQ ID NO: 357342 - DNA, 676 bp, Homo sapiens
  misc_feature: GZ8MTXP02GFLGI.22.36.D03.1.454.CMB.2.raw
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (415)..(415): a, c, t, g, unknown or other
  misc_feature (415)..(415): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttgggtacgagggcccggggggtccctggaccactctcctgtgcagcctcgtggattcacagtcagcagcaatgccagtgagttcgggccgcaggcctccgaaggggtaggggttgcgaggtggggtcgtcggggtattgggaagtggacgtggtnccanaccactacgcacgactccggtggacgggggccctnttcgatcgatcctccgaagacgacgtacttaacccgaaaacaccgagtacgaaacttcgtagactaaaagtcgtaaccacgcccgtacgaacggcccggaccggaacgggacccgtaaccggggtccccgttacgtttaacccgtttcggtcgttaacggaccgttaaaaaccgtacccgttacggttttaacggtttttccgggggacccgtccgggtacccggtaaccgtaccgggttaccgggggccgtaacccgggg

SEQ ID NO: 357343 - DNA, 524 bp, Homo sapiens
  misc_feature: GZ8MTXP02H1RFW.22.36.D03.1.454.CMB.2.raw
  modified_base (220)..(220): a, c, t, g, unknown or other
  misc_feature (220)..(220): n is a, c, g, or t
  modified_base (251)..(251): a, c, t, g, unknown or other
  misc_feature (251)..(251): n is a, c, g, or t
  modified_base (305)..(305): a, c, t, g, unknown or other
  misc_feature (305)..(305): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
  modified_base (458)..(458): a, c, t, g, unknown or other
  misc_feature (458)..(458): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattgggaagtgatgggtgccacacactacgcagactccgtgaggggccnttcatcatctccagagacgattccgaaaacncagtgaatctgacaaatgtacagcctcagcgccgaggacacggccgtcacttcngtgacgaaagacctctatttttgggccgcggccgactacgtggggccagggcaccctgtcaccgtctccttcagtccctcaccacgggcccatcgtctccccngcnccctgctccagctccacctcgacgacgcacgagccggccgtcgggcncgcccgtggtcaaacggctacttccacgcgtactcgctcgacgcgggctcgacgaggcgctaagcg

SEQ ID NO: 357344 - DNA, 630 bp, Homo sapiens
  misc_feature: GZ8MTXP02HYQ4D.22.36.D03.1.454.CMB.2.raw
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (255)..(255): a, c, t, g, unknown or other
  misc_feature (255)..(255): n is a, c, g, or t
  modified_base (307)..(307): a, c, t, g, unknown or other
  misc_feature (307)..(307): n is a, c, g, or t
  modified_base (352)..(352): a, c, t, g, unknown or other
  misc_feature (352)..(352): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttctcactcagggcacgagggtcctgggcccagtctgccctgacccagcctgcctcgtgtctgatcatctggacagtcatcagctatttccngcacgtggaccaagngtgactagtttggtctttgactntcgtctccgtagtaccaacacacccacgaccccaaaccccatcatcattagngtctcacgtcgtccgcctagaggtactctcctcacgtcgtcttcncgacgtccttacgaagtcgtacgaccaacgaccgtccctaccctacattcctcgtcggtccttaccggtaagttcggaaaccggacgttacgttaccttaactttagttacgtagttaccgtttaacgtttacctttaaagtggaccctaccttacgttcgtttacgggttcgggttaccggacggtaccggtaccgtaacggtaaacgtccggtccgtccgtcggtaaccgaccgaacccgacgtcccgaccgtcccccgtacggtcctacctcccg

SEQ ID NO: 357345 - DNA, 531 bp, Homo sapiens
  misc_feature: GZ8MTXP02G6I1T.22.36.D03.1.454.CMB.2.raw
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (317)..(317): a, c, t, g, unknown or other
  misc_feature (317)..(317): n is a, c, g, or t
  modified_base (319)..(319): a, c, t, g, unknown or other
  misc_feature (319)..(319): n is a, c, g, or t
  modified_base (321)..(321): a, c, t, g, unknown or other
  misc_feature (321)..(321): n is a, c, g, or t
  modified_base (324)..(324): a, c, t, g, unknown or other
  misc_feature (324)..(324): n is a, c, g, or t
  modified_base (326)..(327): a, c, t, g, unknown or other
  misc_feature (326)..(327): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactagttggtctttgactctgtctcctgtaccaacaccaccagacccaaacccccatcatcattangtntcactcgcgccngngntcncnntcgctcncngctcagtcncgcacncgccctaccctaacntcncgtggcctctagttgacgtactagtactattattactgtactacgtttacctttaaaagtcggcctacctacttcgttcggttcggtttcggcggtaacgtcgacgtacgtcgaccgttcgcgtcacgcccgaacgtcctcgccccgtacgtccacgtcccg

SEQ ID NO: 357346 - DNA, 665 bp, Homo sapiens
  misc_feature: GZ8MTXP02F3T3X.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggcttaattttaaaaggtgtcaagtgtgcggtgaaggtattggagtcgtgggggaggcgttggtacgagggcccggggggtccctgaccactcctcctgtgcagcctctggattcacagtcagcagcaatcgccagtggagtttcgggccgcgaggcctcgaggggtagggttgcgtaggtgggtcgtcggggtattagggaaggtgacgtggtcgaccacacactacgcaacgtacctccggtaggacgggggcctcgttcaattcactccctaccgaagacgaaccgaactttaaacccggaaaactcgaaaggtacaaattccaggaacctaaaagtccgtaaacacgccctagacgccgaccggagacccgacggtcccgtactttaccgtcttcggtaacggaccgtaaaaccgttccttacgtttttacggtttccgggggaccccgtacggggtccccgtaaacgttaccggggcgggacccggtaacccgggg

SEQ ID NO: 357347 - DNA, 612 bp, Homo sapiens
  misc_feature: GZ8MTXP02JXR7M.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttggtacaggccgggggggtccctgacactctcctgtgcagcctctggattcacagtcagcagcaatgccatgtaggttcggtccgccgacggcgtccgaggggtaggggttgcgtaggtggggtcgtcggggtagttagggagtgagtggtcgcccacacgacgtacgaccgagtaccgtccggtgggacgggggccgtcgttcgactcactctaccgagacgacgactaaccgaaaacacgagtacgaatctacgacaacgtacgtaacgacgacctacgacgccggaccggacggaccgaccggtcccgtcgtacgttcgtacgtacggaccgtaaacgtacccttacgtttacgttttcgggcccggtccggtaccgtaccg

SEQ ID NO: 357348 - DNA, 765 bp, Homo sapiens
  misc_feature: GZ8MTXP02FSGGF.22.36.D03.1.454.CMB.2.raw
  modified_base (187)..(187): a, c, t, g, unknown or other
  misc_feature (187)..(187): n is a, c, g, or t
  modified_base (313)..(313): a, c, t, g, unknown or other
  misc_feature (313)..(313): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggcttattttaaaaggngtcaagtgtgcggtgaagtatggagtcgtgggggagcttggtacgacggccggggggtcctgacactctctgttcagccctgtggattcacagtcagcagacaatgccagtgtaggttcgggtccncgaggccgtaccggaaggggtaacggggtttgaccggtagggttcggggtccgtagggggtagtttacggggtaaagtggtaaggttcgggtacgacccctacgaccgtacgtaacggacgtaacggaacccgtttccgggggaggggaaccgggggtcccgtaccgtttaccgaacttaccgtaaactttcccgtaccgacgggaaacggtaaaccggttaaccgttaaaacccgaaaaaccgtaaccgtaaaggttaaacggtaaaccttcggtaaacttaaacggtaaaacttaccgttaaacgacgtaccgtaccgacggacccgggacgaaccgggtaaccgacccggtaccggttaccttacgttccgtgtacgtaacggtaaaacgtaaccgttacgtttaacggtttccggggaccgtaccgggaccgtaacgtttacccgggg

SEQ ID NO: 357349 - DNA, 760 bp, Homo sapiens
  misc_feature: GZ8MTXP02HWGFA.22.36.D03.1.454.CMB.2.raw
  modified_base (277)..(277): a, c, t, g, unknown or other
  misc_feature (277)..(277): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttggtacgaggccggggggtcctgaccactctcctgtgcacgcctcgtggattcacngtcagcagacaatcgaccatggtaggtttcgggtccccgaccgtaggcctacccggaggggtaaggggtttgacgtaggtggggtacgtcggggtatttaggggaaagttgacgtgggtgacccgacacacgttacggcaaacgacccgttccggtgggacgggggtccccctctttccgactccactccgtaccgaacggaacgtaaccgtaaccgtttaaacccgaaaaccgtaacccgtaagtaacggtaaacgttacgtacgtaacgtaaaacgttacggttaaccaaccgtaccccgaccgaccggacccgggacccggaaccgggaaccgaacccgggtaccccggttccgtttaaccgtttccgttacggtacggaaccggtaaaaccgttacccgtttaccgtttaacggtttttccggggcccggtacccgggtacccgtaccggtaaccggtcggggtaccccggtaccgggg

SEQ ID NO: 357350 - DNA, 653 bp, Homo sapiens
  misc_feature: GZ8MTXP02I96OH.22.36.D03.1.454.CMB.2.raw
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (314)..(314): a, c, t, g, unknown or other
  misc_feature (314)..(314): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctatttccngcacgtgggaccaacngtgactagttggtctttgactctgtctctgtaccaacaccaccgacgaccccaaaccccccatcactctatttatcggtntcctacgtccggtccgcccctagaacggtcttcctcctctacgtccgtctttccacgacgtcctaccgtaacgttccgtacggaccaaacccgaccggtccccctaacccctaaactaccttcctccggtcgggtcccttaccggtacgtttaggaacggtacgtacgtactttaacttaacttacgttacgtttaacttaccctttaaagttacgaccgtacgtacttcgttcgttcggtttcgggcggtacgtaccgaacggtacgtaccgtaccgtaccgtcgtacgaccgaccggaacgccgtcccgcccgtccgtaccgtcgttccgttccccg

SEQ ID NO: 357351 - DNA, 709 bp, Homo sapiens
  misc_feature: GZ8MTXP02HOVIW.22.36.D03.1.454.CMB.2.raw
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtgcttaatttttaaaaggtgtcaagtgtgcggtgaaggtattggagtcgtgggggaggtcgttggtacgacggccggggggtccctgacactctcctgngcagcctctggatcacngtcagcagcaatcgccagtggtacggttcgggcccgccgacggccgtaccggaggggtaacggggttcgacggtagggttcggggtcggttcgggggtattaggggaagtggtagttcgggtcgaccaccactaccgtaccgcgaacggtacccgtccgggtagggaccgggggtccctcttaccgatctaacgtcccgtaccgaacgtaacggtaaccgtaaccgttaacccgaaaaacgtaccgtaggtaacgtaaacgttccgtacgaacgtaaacgtcgtaacaccgacctacgaacggtccggaccggaacggacccgaccgggtacccgttcctttaaccgttcgcggtaacgaccggtaaaacgtcccgttacgttttacgggtttccgggacccggtacggtacccggttaaccgg

SEQ ID NO: 357352 - DNA, 656 bp, Homo sapiens
  misc_feature: GZ8MTXP02GXHAV.22.36.D03.1.454.CMB.2.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
  modified_base (317)..(317): a, c, t, g, unknown or other
  misc_feature (317)..(317): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccagcctgcctccgtgtctggatcatcgtggacagtcgatcagctatttccngcacgtgggaccaangtgactagttggtctttgactctgtctctgtaccaacacaccagaccaacccccatcatcattangtntcactcgcgcctnaggagtctcctcatcgtcttctcacggcctaccaagtccgtggaccaacgaccggtcccctaccctaacctcctaccgtccgtcgggtcccttaccgtaggtttacggacgggtaaccgtacgttccttaaacgtttacttaccgtcgttactaacgtttacccgtttaaatcgggtacctacccgtacgttccgttacgggtttcgggttttccgggacggtacgggtacccgtacggtaacggttacggtacccggttacccggttacggtacccgtacggaaccccgtacggaccgttcccggaccccgttacccggtcgttacccgtttccccgg

SEQ ID NO: 357353 - DNA, 628 bp, Homo sapiens
  misc_feature: GZ8MTXP02GEN71.22.36.D03.1.454.CMB.2.raw
  modified_base (171)..(171): a, c, t, g, unknown or other
  misc_feature (171)..(171): n is a, c, g, or t
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (346)..(346): a, c, t, g, unknown or other
  misc_feature (346)..(346): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccngcctgcctcgtgtctggatcatctggacagtcgatcagtctatttccngcacgtggaccaagngtgactagttggtctttgactctgtctctgtaaccaacacaccgacgaccccaaacccccancatctattanggtntcactcgcgcctgagtctctcctacacgtctcttcncgacgtcctaccgaagtcgtagaccaacgaccgtaccctaccctaaactctcgtcgtacggtaccctacgttaggtttacgaacggtacgtaacgttcttaaactttacgtactacggtcttaacgtttaacttaaagtccgacctaccgtacttcggttcgttcggtttcgggacggtacgaccgaacggtaacgttccgacccgttccggtaccggtccgaccgtaacccgtaacggtcccgtacccccggtccccgttcggtaccctacctttcccccg

SEQ ID NO: 357354 - DNA, 703 bp, Homo sapiens
  misc_feature: GZ8MTXP02F8RGJ.22.36.D03.1.454.CMB.2.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (323)..(323): a, c, t, g, unknown or other
  misc_feature (323)..(323): n is a, c, g, or t
  modified_base (326)..(326): a, c, t, g, unknown or other
  misc_feature (326)..(326): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgccctccgtgtctggatcatctggacagtcatcagctatttccngcacgtgggaaccaanagtgactagttgggttcttttgactcttgtcctccgtggtaacccaacaaccaccccagaccccaaaccccccaatcatacatttagngtntcacgtcgtccgccctagaggtactctcctctactcgtcttctcgacgtcctaccaagtcctacggaccaaacgacccggtcccctaacccgtaaaccctacttcctccgtcgggtcccttacccgtaggtttacggaacggtaacgtacgttacttaaacctttaacgtttaccttacggttactttaacggttttaaaccgttttaaaagttaccggtccgtacccttacgtttccgttccgggtttacgggttttacgggaccgggtaacggtacccgtaaaccggtacgtaccggtaacccgtccgttaccgtaccgtaccgaacccgtacggtcccgtacccgtcccccgttacgtaccgtaccttccccgg

SEQ ID NO: 357355 - DNA, 668 bp, Homo sapiens
  misc_feature: GZ8MTXP02JEBFA.22.36.D03.1.454.CMB.2.raw
  modified_base (301)..(301): a, c, t, g, unknown or other
  misc_feature (301)..(301): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatgccatgagttgggtccnccaggcctccgaggggaacggggttgacgaggtgggtcgtcggggattgggaagtgagtgggcgtccgacacgactacgcgacgacgtccggtggacgggggccctcttacgactcgactcgtccaaggtacgaaccgtacgttaacccgaaaactaccgaagtagtaaactccttaggactaaaagttcgtaacgaacgtccctacgacggccgaccggacggacgaacccgggtcccgttaccttaccgttcgtacggtacggaaccggtaaacgtaacccgttccgtttaaggtttttccggggaccccggtaccgggttacccggaacggttacccggttaccgggggcccgtaacccggggg

SEQ ID NO: 357356 - DNA, 685 bp, Homo sapiens
  misc_feature: GZ8MTXP02IFAWX.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcagtgtgcggtgaaggtattggagtcgtgggggaggctggtacgaggccggggggtcctgacactctcctgtgcagccttctggacttcacagtcagcagcaatcgccatggtaggtttcggggtcccgaccgaggtcccgtccggaagggggtaacggggtttgcggtagggttcggggtcgtcgggggtagttaggggtaagtggtagttgggtacggccctacgacctaacgaccgacgaacgtaccgtccgggttcgggaccgggggtccctccgttacgactactaactccgtacccaaggacgtaaccgtacgttaaaccgaaaacaccgtagtacgtaaattccgtaggaactaaatagtaccacgtcctgacgccgaccggaacggaccgaccggtccgttacctaccgtttcgacggttacgaaccgtaaacgttaccccgttacgtttacgggttttccgggcccggtacggtacccgtaacccggg

SEQ ID NO: 357357 - DNA, 726 bp, Homo sapiens
  misc_feature: GZ8MTXP02GIFRO.22.36.D03.1.454.CMB.2.raw
  modified_base (313)..(313): a, c, t, g, unknown or other
  misc_feature (313)..(313): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggtcgttgggtacgagggccggggggtcctgacactcgtcctgtgcagcctcgtggattcacagtcagcagcaatcgctatggaggtttcgggccnccgaggcctccggaaggggtaaggggttcgacgtagggttcggggtcggttacggggagtttggggaaagttggaatggggtacaccgacaccacgtacgcgaacgtccgtaccgggtgggacgggggccctcttaccgactaccgtaactcccgtaccgacggtaaaccgtaaacgtaccttaaacccgaaaaacgacgaaacggttacgtaaaactccgttaagaactaaaacgttacgttaacgacccggttaccctacgacggggaccccgaacgggacggacccggtaccggtaccgttaccgttaccgttcgtacggtaacggaccgtaaaaccgtaccgttaccgtttacggtttccggggacccgtccgggtaccgtaccgtacgggtccggggaccgaccgggg

SEQ ID NO: 357358 - DNA, 604 bp, Homo sapiens
  misc_feature: GZ8MTXP02F1571.22.36.D03.1.454.CMB.2.raw
  modified_base (408)..(408): a, c, t, g, unknown or other
  misc_feature (408)..(408): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggcccgggggggttccctgacactctcctgtgcagcctctggattcacagtcagcagcaatgccatgaggttgggtccgccaggcctccgaggggaacggggttgcgagggtgggtacgttcgggggattggaaggtgaacgtggtgccacacactacgcagaccgtccgtgacggggccncttcatcatcaccagagaacgacttaccgaaaaccacaagtacgaaatctagaccaaaagtacgtaacacgcccgtacgaacgccggaccggaacggaccgaccggcccgtacttaccgttctcgtacgacgaaacgtacctcgttaacgttttcgggccgtccggccgtaccgtacggtacggggacgaccgggg

SEQ ID NO: 357359 - DNA, 583 bp, Homo sapiens
  misc_feature: GZ8MTXP02FUL41.22.36.D03.1.454.CMB.2.raw
  modified_base (347)..(347): a, c, t, g, unknown or other
  misc_feature (347)..(347): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtctttgactctgtctctggtaccaacaacacccacgaccaaaccccccactcatctattatgtgtcactcgtcggccctcgagtacgtctctcatcgcttcncagctacagtctgacaacgcgcctaccctaacactctcgtcggctctagttgaggtacgtagtcttacttatactcgatacgtttacttaaagtacggccgtacctactcgttcggttcgggtttcgggacggtacggtccaaccgggtaaacgtcggtacccgttaccgtccggtacgaaccgtaaccccgaacgggccttccggtaccccccgtcggtcccgtaccgtttcccg

SEQ ID NO: 357360 - DNA, 645 bp, Homo sapiens
  misc_feature: GZ8MTXP02JVRRA.22.36.D03.1.454.CMB.2.raw
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
  modified_base (393)..(393): a, c, t, g, unknown or other
  misc_feature (393)..(393): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccggggggtccctgacactctcctgtgcagcctctggattcacagtcagcagcaatgccatgagttgggccncaggctccgaggggaggggttgcaggtgggtctcggggattgggaagtgagtggtgccacncacgtacgcagactccgtgacgggggcccnttcgatcatctccagacgacgacttaccgaaaactacgaagtacgaaatccttaggaaccaaaagttcgtaacgaacgaccctacgaacgcccggaccggaacgggaccgaacccggggcccgttaccttacgtttcccgtaggttacggaccggtaaaacgtacccgttacgtttaacggtttttccggggacccggtccggggtacccggtaaccgttaaccgggttccgggggacccgtaacccggggg

SEQ ID NO: 357361 - DNA, 641 bp, Homo sapiens
  misc_feature: GZ8MTXP02FWR8K.22.36.D03.1.454.CMB.2.raw
  modified_base (618)..(618): a, c, t, g, unknown or other
  misc_feature (618)..(618): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcatcagctatttcctgcacgtgggaaccaacagtgactagttgggttcttttgactctgtctcctggtaacccaacaaaccacccacgaccccaaaccccccatcatctatttatggtgtcactcgtccggccctgaggacttctaccctcactccgtctttcctacgacggtcctacctaaacggttcgtacgggacctaaacgacccgggtccccttaaccccgtaaacctcttcccgtcgtacgggtccttcccgtaaggttttacgaacggtacgtacgttactttaacgtttaacttaacgtcgtacttacgtttacctttaaaagtccggactcctacttcgtcgttaggtttcggacgtacgctacgacgtccgaccgtccgtcgtccgacaaccgtacgccgtcccncccgtacggtcccacgtttcccg

SEQ ID NO: 357362 - DNA, 709 bp, Homo sapiens
  misc_feature: GZ8MTXP02ICJ5X.22.36.D03.1.454.CMB.2.raw
  modified_base (220)..(220): a, c, t, g, unknown or other
  misc_feature (220)..(220): n is a, c, g, or t
  modified_base (327)..(327): a, c, t, g, unknown or other
  misc_feature (327)..(327): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttctcactcagggcacagggtcctgggcccagtctgcctgacccagcctgcctccgtgtctggatcgatctggacagtcgatcagctattttccgngcacgtggaccaagtgtgactagtttggttctttgacttctcgtctacgtacggtaaccaacaccacccgaacgaccccaaaccccctatactactactatttacgngtacgtcctacgtccggtccggcctacgacggtcttctaccctacgtactccgtacttcgtacgacgtcctaccgtaacgtccgtacgacctaaccgtacccgtacccctaccccgtaaactaccgttccgtaccggttacgggtaccttaccggttacgggtttacggaacggtaaccggttacgttacctttaacgtttacgttacgtacgttaccgtttaacgttttaaccgtttaaaggttaccggtcctaccgttacgttcggttcgggtttacgggttcgggacggtacggcgtaccggtacggttccggtacccgtcggtaccgtaccaccggtaacccgtacgtcccgtccgccccgtcggtacctaccgtccg

SEQ ID NO: 357363 - DNA, 659 bp, Homo sapiens
  misc_feature: GZ8MTXP02H89M7.22.36.D03.1.454.CMB.2.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (454)..(454): a, c, t, g, unknown or other
  misc_feature (454)..(454): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacgagggtcctgggcccagtctcgccctgacccagcctcgcctccgtgtctggatcatcgtggacagtcgatcagctactttccngcacgtcgggaaccaacgngtagactagtttggttctttgactctcgttcctccgtacgtaacccaaacaaccaccgaaccgaaccccctaaaccccccatcaactctaagtttagtggtactacctaccgtccggtccgccctacgtacggtactctccctacacttccgtcttcacgacgttcctacgtaacgtccgtacgacctaaccgccgtccctaccctaacncctcgtcgtcggtctacgtggttacgacggtactacgttacttacttacgttacgtacgttacgtttacgtttaacgttaaacgtacgtccgtacttaccgttcgttcgggtttcggttcgggcggtacgcggtaacgtacggttccgaccgttccgacgtccacggccgaacgtcctaccgccccgtacgtccctacgttcccg

SEQ ID NO: 357364 - DNA, 739 bp, Homo sapiens
  misc_feature: GZ8MTXP02HCBHX.22.36.D03.1.454.CMB.2.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctcgccctgacccagcctgcctcgtgtctgtatcatctggacagtcgatcagctatttccngcacgtgggaccaacngtgactagttggttcttttgacttctgtctccgtacgtaacccaacaaccaccccacgaccccaaaccccccatcactctaatttagtgtcgtactaccgtccgtccggccctcgtacggtacgttctccccgtctacgtccgtctttccgtacgacggtccctaccgtaagttccgtacggaccctaaacccgacccggtacccccttaaccctaaacctacgtttcccgtccggtcgggtacccttaccgttaggtttacggacggttaaccggtactttaccgtttaaactttacgtttaccgacggtttccttaaacggtttttacccgtttaaaagtccggtaccctacctttaaccgtttcggttcggttttacggggtttccggaccggtaacggtaccccgaacggttaacggtccgtaacccggttcccgtaccggtaccgtaccgaacccgacggtcccgtccgtacccccgtacggtccctaccgtttccccg

SEQ ID NO: 357365 - DNA, 597 bp, Homo sapiens
  misc_feature: GZ8MTXP02I5Z53.22.36.D03.1.454.CMB.2.raw
  modified_base (280)..(280): a, c, t, g, unknown or other
  misc_feature (280)..(280): n is a, c, g, or t
  modified_base (390)..(390): a, c, t, g, unknown or other
  misc_feature (390)..(390): n is a, c, g, or t
  modified_base (439)..(439): a, c, t, g, unknown or other
  misc_feature (439)..(439): n is a, c, g, or t
  modified_base (463)..(463): a, c, t, g, unknown or other
  misc_feature (463)..(463): n is a, c, g, or t
  modified_base (496)..(496): a, c, t, g, unknown or other
  misc_feature (496)..(496): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtatggagtcgtgggggaggcttggtacaggccgggggggtccctgacactctcctgtgcagcctctggattcacngtcagcagcaatgcctatggaggtttggggtcccgccgacggctaccggaggggtaaggggttgcgaggttggggcggtcggggtattgggaagtgagtgggtcgcccanaccgactacgcacgacgtcccggtgggacggggccgtcttcatcatccnccgagacgacgattaccgaaaacncgagtagaatctagacaaagtcgtacacgccanacgcgtaccgacggtacgaccggtccgtctaccgttcgtcgtacgaacggtaaacgtccgttactttacggtttccggggccgtccgggtaccgtaaccgg

SEQ ID NO: 357366 - DNA, 656 bp, Homo sapiens
  misc_feature: GZ8MTXP02JV6XQ.22.36.D03.1.454.CMB.2.raw
  modified_base (219)..(219): a, c, t, g, unknown or other
  misc_feature (219)..(219): n is a, c, g, or t
  modified_base (248)..(248): a, c, t, g, unknown or other
  misc_feature (248)..(248): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccagcagtgtatgttggtntcttatactatgtctctggtaccagccaccacccacgaccaaaacccccccatcactctatttacgtggtcgtcacgttcgtccggccctcgacgggactcctctccatccgtacttcctcgaggtccctaccgaaggttccgtacgggaccaaacccgaccggtcccctaccccctaaactcttcccgtacgtcgggtcctaccgttaggtttcgaacggtacgtacgttcctttaacttacttacgtcgtaccgttaacgtttaacccgtttaaagttaccgggtctacccgtacttcggttacggtttcgggtttccggacgggttacggaccgtaacggtacggtccggtacccgttccgtcggtaccgacggacccggacggtcctccggcccccgtttccgg

SEQ ID NO: 357367 - DNA, 590 bp, Homo sapiens
  misc_feature: GZ8MTXP02FHLNQ.22.36.D03.1.454.CMB.2.raw
  modified_base (310)..(310): a, c, t, g, unknown or other
  misc_feature (310)..(310): n is a, c, g, or t
  modified_base (363)..(363): a, c, t, g, unknown or other
  misc_feature (363)..(363): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactatggtcttttgactctgtctcctggtaccaacaacacccacgaccaaaccccccactcactcattatggtntaactcgtcgcctcaggatctctccatcgctctcacgctcaagtctgacaacncgcctaccctaacatcctcgtggctccgtagttgaacggtacgtagtactaacgttacttactggtctaagtttacctttaaaagttcggcctacctaccgttcttcggttcgggtttaccgggcggtaacggcgtaaccggaaagttcgtacccgttccgtccgtaccgacgtacccccgaaggtcccgtacgtccccccgtaggttccacgttcgtttcccccgg

SEQ ID NO: 357368 - DNA, 607 bp, Homo sapiens
  misc_feature: GZ8MTXP02H3JC8.22.36.D03.1.454.CMB.2.raw
  modified_base (406)..(406): a, c, t, g, unknown or other
  misc_feature (406)..(406): n is a, c, g, or t
  modified_base (466)..(466): a, c, t, g, unknown or other
  misc_feature (466)..(466): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaaggtgtcaagtgtgcggtgaaggtattggagtctgggggaggcttggtacaggccggggggtccctgacactctcctgtgcagcctctggattcacagtcagcagcaaatgccatgagtttgggtcctcaaggctcccgaaggggaagggggtttgcgtagggtggggttccggtaggggtagttagggaagtgacgtggtcgacacacactacgcgaacgccgtccggnggacggggcctacttacactcacttcacgagacgaacgtactaaaccgaaaacacagtanaaattcagaaactaaagtagtacacgacacgacgacgacgacgacgacgtacgtactacttacgtacgtacgaacgaaacgtacgttacgttacgtttaacggtccggtaccggtaccgtaccgtacggtacggacggacg

SEQ ID NO: 357369 - DNA, 777 bp, Homo sapiens
  misc_feature: GZ8MTXP02JQ8C8.22.36.D03.1.454.CMB.2.raw
  modified_base (304)..(304): a, c, t, g, unknown or other
  misc_feature (304)..(304): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggtagtttgggctgaagtggtcttttgcttgtggtcttaattttaaaaggtgtacaagtgtgcggtgaaggtattggagtcgtgggggaggcttgggtacgacgggcccgggggggtccctggacctactcctccgtgtgcacgtcctcgtggtacttcacgagtcagcanacaatcgacctagtggtacggtttccggggtcccgaccgacgggtcccgtaccggaagggggtaaggggttcgacggtagggttcggggtcggtacggggtagttagggaagtggtaccgttggtacgacccaacgtacgaacctacggccgtaacgtaccggttccggtacggggaccgggggcccgtaccttacgtactaccgtaccgttaccgtacccgaaggtaaccgaaccgttaaaccgttaaaccccggaaaaacctacgtaaagtaacgtaaacgttaccgtaacggtaactaaacgtacgtaccaacgtccgacgaccgacccggacggacggaaccgtccgggtacccttcgttacggttcttacggaaccgtaacggtaaaccgtacccgtttacgtttacgggtttccggcccggtaccggtacccgtaacggtccgggtaccggggaccctacccggggg

SEQ ID NO: 357370 - DNA, 641 bp, Homo sapiens
  misc_feature: GZ8MTXP02IJN5X.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattgggagtcgtgggggagcttggtacaggccggggggtccctgacactctcctgtgcagcctctggattcactagtcagcagcaagtgccagtcgaggtttcgggtcccgccgtaggccttaccggaaggggtaaggggttcgaccgtaagggttcggggtcgtacggggtatttagggaaaggtcgtagtggtcgacccacaacaccgtacgccgaagtacgtcccggtaggacgggggtcccacttacgactacactctaccagaacgtacgtaacttaaccgaaaacaacgaagtacaatacgtagacaaatacgtacacgccgtacgacgacgaccgacggaccgaccggtccgtactacttacctgtacgaacgtaacgtaccgttcttacgtttcggacgtccggaccgtacgtaccggacgggtaccgaaccgg

SEQ ID NO: 357371 - DNA, 600 bp, Homo sapiens
  misc_feature: GZ8MTXP02H8J54.22.36.D03.1.454.CMB.2.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (238)..(238): a, c, t, g, unknown or other
  misc_feature (238)..(238): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccagcctgcctcgtgtctggatcatcgtggacagtcgatcagctatttccngcacgtgggaaccangtnactagttggtctttgactctgtctctcgtaccaacacaccacgaccaacccccatcactcattagngtntcactcgtcgcctcgagacgtctcctcactcgtctctcacggcctcgaaacgtcgtacgaccaacgacgccctaccctaacactcgtcgtacggcccttacgtagtttggaacgccgtagtcttaatttacttactggtaccttagtttacctttaaagtaccggtctacctacgttacgttcgggtttcgtttccgggacggttacggcgtaacccggtaaagtccggtacccgttccgacgttccgacgtcccgtaaacggtctcccggaccccttcggtccacccttccg

SEQ ID NO: 357372 - DNA, 754 bp, Homo sapiens
  misc_feature: GZ8MTXP02GPFSZ.22.36.D03.1.454.CMB.2.raw
  modified_base (185)..(185): a, c, t, g, unknown or other
  misc_feature (185)..(185): n is a, c, g, or t
  modified_base (279)..(279): a, c, t, g, unknown or other
  misc_feature (279)..(279): n is a, c, g, or t
  modified_base (324)..(324): a, c, t, g, unknown or other
  misc_feature (324)..(324): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggngtcaagtgtgcggtgaaggtattggagtcgtgggggagcttggtacaggccgggggtcctgacactctcctgttcagctctggatcacagtcancagcaatgcatgagttggccgcaggctccgaaggggaaggggttncgtaggtcggggtcgtcgggggtaattcggggaaagttggaagttcgggtaggacccccaacgaccgaaccttaacgggaccaaacgggtaaccttcccggggttaggggaaccgggggtacccgtcccgtttaccgacgttacgtaaacgttcccttaccccgaagggtaacggaaccggtaaacgttaaaccccgggaaaaaaacaacccgtaaagggttaacgtaaacgttaccttaacggaaccctaaaagttacgtaaccgtaacgacccgttacgaacggaccggacccgggaacgggaaccgtaccggggtacccgttaccgttaaacctttccgtacggttacggaaccggtaaaacgtaacccgtttacgttaaacggtttttcggggcccggtaccgggtacccggacgttaacccgggg

SEQ ID NO: 357373 - DNA, 599 bp, Homo sapiens
  misc_feature: GZ8MTXP02IV1ZK.22.36.D03.1.454.CMB.2.raw
  modified_base (449)..(449): a, c, t, g, unknown or other
  misc_feature (449)..(449): n is a, c, g, or t
  modified_base (470)..(470): a, c, t, g, unknown or other
  misc_feature (470)..(470): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccggggggtccctgacactctcctgtgcagcctctggattcacagtcagcagcaatgccatgagttgggtccgccaggctccgaggggaaggggttgacgtaggtcgggtcgtcggggattggaagtgagtggtgcccacgacaactacgcgagacctccgggtgacgggggccgcttcgactcatcctccgagacgacgacttaccgaaaacacagtanaatctagactaaatgtacacncctacgagccgaccgaggaccacggcccttacgtacttcgtacgacgaacgtaaacgtaccttcgtttaacgttttcggggacccgtaccgggacccgtaacgtaccggtccggggtaccgtaaccggg

SEQ ID NO: 357374 - DNA, 652 bp, Homo sapiens
  misc_feature: GZ8MTXP02IO8P0.22.36.D03.1.454.CMB.2.raw
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
  modified_base (275)..(275): a, c, t, g, unknown or other
  misc_feature (275)..(275): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctcgccctgacccagcctgcctccgtgtctggatcatctggacagtcgatcagctatttccngcacgtggaccanagtgactagttggtctttgactctgtctctgaccaacaaccnccacgaccccaaacccccatcatctatttagtggtcgtcaccgtcgtccggccctagaggtactctccgtcactccgtcttctacgcggtcctacctacgttcgcgtaccaacgtcccggtccctaccctaaactctcgtcgtacggccttacgtaggtttacgacggtactacgtacttacgttacttacgtcgtacttacgttttaaccttaaagtcggtcctaccttacgttcgttccgggttttagggttccggggaccgggttaacggccgtaaacccgggtaacgtttcccggacccggttccgtacccggttacgaccgtaaccgacggtcccgtaccccggttccccggtcgtaccttccgtttccccg

SEQ ID NO: 357375 - DNA, 638 bp, Homo sapiens
  misc_feature: GZ8MTXP02JHQLQ.22.36.D03.1.454.CMB.2.raw
  modified_base (304)..(304): a, c, t, g, unknown or other
  misc_feature (304)..(304): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
  modified_base (478)..(478): a, c, t, g, unknown or other
  misc_feature (478)..(478): n is a, c, g, or t
  modified_base (502)..(502): a, c, t, g, unknown or other
  misc_feature (502)..(502): n is a, c, g, or t
  modified_base (519)..(519): a, c, t, g, unknown or other
  misc_feature (519)..(519): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtctttttgcttgtggtcttaatttttaaaaggtgttcaagtgtgcggtgaaggttattggagtcgtgggggaggtcttgggacaggccgggggtccctgacactctcctgtgcagcctctgattcgacagtcagcagcaatgccangagttggcccgccaggctccgagggagggttgcgtaggtggcttcggggnttcggaagtcgagtgggtacncccgacgacgtaccgtacggccgaggtaaccctcgggttagggacgggggtcccgtccttacacttcaactcctccgtagaacgggacaacgttacgaaaacncgaagttacgtaaatcccggtaanaacgtaaagtcgtaacncgaccacgaccgaccggaccggtacggaacccgtaccggtcccgtacttaccgttacgtacggtaccgaacgtaacgttaccgtttacgtttacggttccgggccgtccggaccgtacg

SEQ ID NO: 357376 - DNA, 744 bp, Homo sapiens
  misc_feature: GZ8MTXP02IAHBX.22.36.D03.1.454.CMB.2.raw
tcagacatacgcgtcacgaccggtgctcgatttagctgcgtcacgatctctcttgggggagagaggagcccagccctgggattttcaggttgttttcatttggtgatcaggactgaacagagagaactcaccatggagtttgggctgaagtggcttttgcttgtggcttattttaaaaggtgtcaagtgtgcggtgaaggtattggagtcgtgggggaggcgttggtacgaggcccggggggtcctgacactctcctgtgcagccctgtggattcacagtcagcagcaaatcgaccagtggtaggtttcgggtccccgccggacggccgtacccggaagggggtaaggggtttcggacgtaggggttcggggttcggtacgggggtagtttaggggaagttggagttacggggtcgacccgaacgtaaccgaccgttaaccggcctaacgggtaacccgtcccgggttggggaaccggggggtcccctactttacgacttcacttcccaccgaagaacgtaacgtaaccgttaacccgaaaacaccgagtagaaactctacgaactaaagtacgtacacgtcctacgacggccggaccggaaggacccgtaccgggtacccgttaccttacgtttcgttacggttacgaaaccggtaaacgtaccgtttacgtttaacgggtttttccggggcccggtaccgggtacccgtaccgtaccggggtaccggggaccggacccgggg

SEQ ID NO: 357377 - DNA, 707 bp, Homo sapiens
  misc_feature: GZ8MTXP02G6O48.22.36.D03.1.454.CMB.2.raw
tcagacatacgcgtcacgaccggtgctcgatttagctgcgtcacgatctctcttgggggggggtctcaggaggcagcgctctcgggacgtctccaccatggcctgggctctgctattcctcaccttcctcactcagggcacgagggtcctgggcccagtctgccctgacccagcctgcctccgtgtctggatcatcgtggacagtcgatcagctactttcctgcacgtcgggaaccaacgagtagactagttgggttctttgacttctcgtctccgtacgtaaccaacaaccacccgaccgaaccccaaacccccctatcactactattagtggtctcacgtccgtccgccctgacgtacgtctctctactccgtctcgacgacggtcctaccgtagtcgtacggaccaaccgtcccgtacccttacccgaaacctcttcccgtcgtaccggtccttaccggttagggtttacgaacgggttacgttagttacctttaacgtttagtaccgtttacgtaccgtttaacgttttaaaccgtttaaggtacccggccctaccttaccggtttcgtttcgggttacgggtttccgggacggtaccggtaccgtacggtacggtcccgtacccggtaccgtcggtaccgccggtaacccgtcggtccccgttcccgtcccccgtcggtcccttaccgttccgtttcccccg

SEQ ID NO: 357378 - DNA, 643 bp, Homo sapiens
  misc_feature: GZ8MTXP02HXZEQ.22.36.D03.1.454.CMB.2.raw
  modified_base (227)..(227): a, c, t, g, unknown or other
  misc_feature (227)..(227): n is a, c, g, or t
  modified_base (244)..(244): a, c, t, g, unknown or other
  misc_feature (244)..(244): n is a, c, g, or t
  modified_base (433)..(433): a, c, t, g, unknown or other
  misc_feature (433)..(433): n is a, c, g, or t
  modified_base (598)..(598): a, c, t, g, unknown or other
  misc_feature (598)..(598): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacgagggtcctgggcccagtctcgccctgacccagcctcgcctccgtgtctggatcattcgtggacagtacatcagtctactttccngacagtacggaaccaanagtgactagttggttctttgctctgtctaccgtcgtaaccaacgaccaccgagaccaaaccgtcccaatcatctattagtgtctctactcgtcccggacctacgaggtacttccctctaccagtccgtacttccgtacacggtccttacctacgttcgcggaaccaaccgcccgtaccctacctaaacnctctcggtgtactcgttaggtgcgacgtactttactacgtttataaacgttgtacgttaactttaccttaaagtcggaccttaccctgtttacgttcggttcgggtttaccggcggtaacgtccggaaaacgtcgttaccggtaacccgtcccgttacggaaccnccggaaccctacggtccgtaaccccgtcccgtccgttacgtcccg

SEQ ID NO: 357379 - DNA, 730 bp, Homo sapiens
  misc_feature: GZ8MTXP02FQ5GZ.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgctttgtggtcttaattttaaaaaggtgttacaagttgtggcggtgaaggtattggagtcgtgggggaggtcgttggtacgagggcccgggggggtcctggacactcctcctgtcgcacgcctcgtggacttcacgagtcagcagcaatcgaccagttgaggtttcgggacccgccgaaggccgtacggaggggtaaggggttgcggaggttgggtcggtcgggtagtggaagtgacgtgtcgacacacacgtacgcgacgaccgtcgggtggacgggcctacgttcacgtcctactaccgaccacgggtacgtaaccgtaaccgttaaaccaaaaaccgccgtaaagttacgtaaactacgttacggaaactaaaacgtttcgaaacccggacgtacccctaccgaacggcccggaacggtaaccggaacccgtacccgggtacccttaccgttaccgttacgttaggaaccggtaaacgtaaacccgggttacctttccgggtttaaacggtttcccggggaacccggtccggtacccggacgttaccgggacccggggcgtaccccggg

SEQ ID NO: 357380 - DNA, 706 bp, Homo sapiens
  misc_feature: GZ8MTXP02GY8DU.22.36.D03.1.454.CMB.2.raw
  modified_base (235)..(235): a, c, t, g, unknown or other
  misc_feature (235)..(235): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacngtgactagttggtctttgactctgtctctgtaccacaacaccacgaccaacccccactcatcatttatgtctaactcgtacggtccctacgaggacgtctctacctactccgtctttctccgtacggtcctccgtaaacgttccgttacgggacccgaaaccgtacccgggtaccccctttaccccctaaaccctaacttcccgttcgtaccgggggtacccttacccgtacggttttacgggaacggtaacgtaacggttacctttaaacgttttaactttaccgttacggtaccttaacgttttacccttttaaaagtttaacgggccctaccgtaaccgttcgttacggtttcgggtttaccgggcggtacggtacgtacccggtaagtccggtacccgtaccgttccggtacctacgacccgtaacggtccgtacccgtcccccgtacggtccaccgttcttccccg

SEQ ID NO: 357381 - DNA, 607 bp, Homo sapiens
  misc_feature: GZ8MTXP02I14F9.22.36.D03.1.454.CMB.2.raw
  modified_base (284)..(284): a, c, t, g, unknown or other
  misc_feature (284)..(284): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttgggtacgagggtcccgggggtcctgactactctcctagtgcagccctgtggacttcanagtcagcagacaagtcgacctagtggtaggttcggtcccgacgaggtcctaccggaggggtaacgggttcgcgtaggttcgggtacggtcggggtataggggagtgacgttggcgaccacgtacacgtacgccgagtaccgtcggtaggaccgggccgtctacactacacttcaccgagtacgacgtactaaccgaaaacagtaaggtactaatactagaaccaatacgacgacgacctgaacgccgacggacgacgtaccgtcgtctcgttcgagtcgtaacgaaaccgtcttacgttcggttcggccgtcggaccgtaacg

SEQ ID NO: 357382 - DNA, 641 bp, Homo sapiens
  misc_feature: GZ8MTXP02HB7C5.22.36.D03.1.454.CMB.2.raw
  modified_base (222)..(223): a, c, t, g, unknown or other
  misc_feature (222)..(223): n is a, c, g, or t
  modified_base (238)..(238): a, c, t, g, unknown or other
  misc_feature (238)..(238): n is a, c, g, or t
  modified_base (242)..(242): a, c, t, g, unknown or other
  misc_feature (242)..(242): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctcgccctgacccagcctgcctccgtgtctggatcatcgtggacagtcgatcagctatttccnncacgtcggaaccaanagtnactagttggtctttgctctgtctcctgaaccaacaccaccacgacccaacccccatcatcattgtgtctcactcgtcgccctagacgtctctcctcgactcgtaccttctccacggtcctaccgtaagttcccgtacgaacctaacgcccgtaccctaccctaacctacgttccctacggtccggtcccgttaccgttacggttacggacggtaacgtacgttacgttactttacgttacgtacgtacgtttaacgtttaacgtttaagttaccggcctaccgtcttcgttcggttcgggtttcggcggtacgaccgtacggtaacgtccgtaccgtccgtccgtaccgaccgcccgtaacgtcccgtaccgtccccgtccgtaccgtaccttaccccg

SEQ ID NO: 357383 - DNA, 674 bp, Homo sapiens
  misc_feature: GZ8MTXP02GG4FF.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcgtgaaggtattggagtcgtgggggagcttggtacgaggccggggggtcctgacactctcctgtgcacgcctctggattcacagtcagcagcaatgaccatgaggtttcgggccgccgtaggcctaccggaaggggtaaggggttgcgtagggtgggtcgtcggggtagttggaagtgagtggtcgcacacacctacgcgacgacgtcggtggaccgggggcctcgttcactcactctacgagacgaacgtacttaaccgaaaactacgaagtacgtaaacttcgacgtaacctaaattacgaacgaccgacccgttacgacggaccggaaccggaacgggttaaaccgcccgggtaaccggttccgttaaccttcgttaccggacgtaaccggggtaaaaccttaacccgttcgtttaaacggttttcccggggacccgtacggtacccgtacgttaaccggccggggaccgtaacccgggg

SEQ ID NO: 357384 - DNA, 621 bp, Homo sapiens
  misc_feature: GZ8MTXP02HAFTW.22.36.D03.1.454.CMB.2.raw
  modified_base (309)..(309): a, c, t, g, unknown or other
  misc_feature (309)..(309): n is a, c, g, or t
  modified_base (331)..(331): a, c, t, g, unknown or other
  misc_feature (331)..(331): n is a, c, g, or t
tcagacatacgcgtcacgaccggtgctcgatttagctgcgtcacgatctctcttggggtggggtctcaggaggcagcgctctcgggacgtctccgccatggcctgggctctgctattcctcaccttcctcactcagggcacagggtcctgggcccagtctgccctgacccagcctgcctccgtgtctggatcatctggacagtcgatcagcatttcctgcactgggaaccaacagtgacattgggtctttgactctgtctcctggtaccaacaacaccacgaccaaaccccccaatcatcattatggtntcactcgtcgccctcaggatcncctcatcgcttctcaggcctacaagtcctggaccaacaccggccctacccgtaaaccacttccgtcgtaggcccttccgtaggtttcgacggacgtacgtcttaacttatttaactcgtacttacgttacgtttaaaattacggtcacctacgtcttcggtttacggttttcgggcggttaacggacgtaaccggtaacgttacggacccgttcccgtacggggttacaaccgggaaccccgtaaaggtccgtttaccggccccccgtttcggtaaccctactttccccg

SEQ ID NO: 357385 - DNA, 678 bp, Homo sapiens
  misc_feature: GZ8MTXP02HCOVJ.22.36.D03.1.454.CMB.2.raw
  modified_base (309)..(309): a, c, t, g, unknown or other
  misc_feature (309)..(309): n is a, c, g, or t
  modified_base (374)..(374): a, c, t, g, unknown or other
  misc_feature (374)..(374): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtacaagtgtgcggtgaaggtattggagtcgtgggggagcttggtacgaggccggggggtccctggacactctcctgtgcagcctctggattcacagtcagcagcaaatgccatgtacggttggcccncgaggctccggaggggtagggtgcgaggtggtcgtcgggattggaagtcgagtgcgcacacgtancgnagtacnccggtagcgggggtccntttccagttcaactctaccgagaacgaacgtacttaacccggaaaaactccgaggtaacgtaaacgtacgtaacgactaaaagtttaccggaacgtaaccgccctacgaacggccgacccggaacgggaacctccgggggtaaccccttcgttaacccgtttcggacggttaccggaaacgttaaaaccgtccccgtttagtttaccggttttcgggggaacccccgccggggtacccgtaaaccggtttccggtaccgggggacccgtaacccgggg

SEQ ID NO: 357386 - DNA, 692 bp, Homo sapiens
  misc_feature: GZ8MTXP02FLZKS.22.36.D03.1.454.CMB.2.raw
  modified_base (220)..(220): a, c, t, g, unknown or other
  misc_feature (220)..(220): n is a, c, g, or t
  modified_base (252)..(252): a, c, t, g, unknown or other
  misc_feature (252)..(252): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccaggggaaggggttgcagtgggtctcggggattggaagtgatgggtgccacgacactacgcagactccgtgagggccncttcatcatctcagagacgattaccgaaaacncagtgaatctgcaaatgtacagcctcagcgcgagacacggccgtctacttcgtgtcgacgaaacgtaccttcgtttacgtttttcgggccggtccgggaccgtacccgttacggtcgggggccgaacgggggcccaaccccggttgggtcccgtaaccccggttccttaccgtttccgaaccgtccccgtacccgaacccgtaaacccgggggtcccacgtttcccgggtcccctttcccccggtcgggcccgccccgttacgcctcccgaacggcgccacccgtccggacgacgccgaaccgcggcccggccgtcggggccgttcggcccgttagggacccgtaaggtaccctaccgtttcccgaccggtaccggtaattccggttacgtggaccgggccggggttcgacggggtacgaacggggtccacggtaacgtg

SEQ ID NO: 357387 - DNA, 628 bp, Homo sapiens
  misc_feature: GZ8MTXP02GHLAP.22.36.D03.1.454.CMB.2.raw
  modified_base (364)..(364): a, c, t, g, unknown or other
  misc_feature (364)..(364): n is a, c, g, or t
  modified_base (393)..(393): a, c, t, g, unknown or other
  misc_feature (393)..(393): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggctattttaaaggtgtcaagtgtgcggtgaaggtattggagtcgtgggggaggcttggtacgaggccggggggtccctgacactctcctgttcagcctctggattcacagtcagcagcaatgccatgagttggtccgcaggctccgagggagggttgcgaggtgggtctcggggattgggaagtgagtgggtnacccacacacgtaccgcgagacctccggnggacggggcccgctttacgatcgactctacccgagacgaccgtattacccgaaaacaacagtacgaagtctaggacctaaaagtcgtaacgacgaccctacgacggccgacccggaaggacccgaccgggtacccgtacgttaccgttccgttgtacggaccgtaaacgtaacccgtttacgttaacgtttttcgggggccccgtaccggggtacccgtaccggtttaacccggg

SEQ ID NO: 357388 - DNA, 674 bp, Homo sapiens
  misc_feature: GZ8MTXP02HU2T2.22.36.D03.1.454.CMB.2.raw
  modified_base (219)..(219): a, c, t, g, unknown or other
  misc_feature (219)..(219): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaaccaacagtgactagttgggtcttttgactctgtctcctcggtaaccaacaaccaccccacgaccccaaaccccccaactctactctatttagtggtcgtctacgtccgtccgccctcgaggacgttctccgtcactcgtctttactcgacgcctacctaagttctacggtaccaaccgaccgtcccctaccctaaaccacttcctcgtcgggtacccttcgtaggtttcgaacggtacgagttaccttaacttactttactacgtacttacgttttaaccgtttaaagttacggtcctacctacgttccgtttacgggttcgggttttcgggacgggtacggtaccgtaccggtaaacgttcggtaccccggttcgtccgttaccgaccgtaaccccggtacggcccgttcccgcccccgttccggtaccttaccgtttccccg

SEQ ID NO: 357389 - DNA, 671 bp, Homo sapiens
  misc_feature: GZ8MTXP02GCEE3.22.36.D03.1.454.CMB.2.raw
  modified_base (187)..(187): a, c, t, g, unknown or other
  misc_feature (187)..(187): n is a, c, g, or t
  modified_base (276)..(276): a, c, t, g, unknown or other
  misc_feature (276)..(276): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggcttattttaaaaggngtcaagtgtgcggtgaaggtatggagtcgtgggggaggcgttgggtacgagggccggggggtcctgaccactctcctgtcgcagccctntggattcactgcagcagcaatcgcagtggacggttcggtcccgcgacggccgtaccggaggggtaagggttcgcgtagggtcggtcgtacggggtattgggaagtggacgttgggactccgacaccgaccgtacgacgtaaccgtaccgttccgggacgggacggggccctacttcgactctactccgtaccgaaggaacgtacgtaaacgttaacccgaaaactaccgaaggttaacgtaacgtacgtaacgaaacctaaaacgttcgtaaaccgcgtaacccgacgacggacccgtacgggaacggtaccgaaccgggttccctactacgttccgtagacgaacgtaaacgtccttacgtttacggttccggccggtaccgtacgtaacccgg

SEQ ID NO: 357390 - DNA, 691 bp, Homo sapiens
  misc_feature: GZ8MTXP02IYST9.22.36.D03.1.454.CMB.2.raw
  modified_base (255)..(255): a, c, t, g, unknown or other
  misc_feature (255)..(255): n is a, c, g, or t
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgcccctgacccagcctgcctccgtgtctggatcatctggacagtcgatcagcatttcctgcactgggaccaacagtgacagttgggtcttttgactntgtctctggtaccaacaacacccaggccaaacccccccatcatcatttacngtntcactcgtcgcctcagactctctccatcgtcttctcacggtctaccaagttcctagggccaaaccgaccggccccttacccctaaaccctacttccttccgtcggggacccttcccgtaacgttttcggaacggtaccgtaagttaccttaacgttttaaatttaccgttagtacttacgttttaaccccgttttaaaagttacgggtaccgtaccctaacgttccgtttacgggtttcgggtttttccgggacggggtaacgggtaccgtaacccggtaaacgttacggtaacccggttcccgttaccggtccaccggtaccccgaaacggggtccctaccgggccccccttcgggtaccccaccgtttccctttccccgg

SEQ ID NO: 357391 - DNA, 632 bp, Homo sapiens
  misc_feature: GZ8MTXP02HX7M9.22.36.D03.1.454.CMB.2.raw
  modified_base (281)..(281): a, c, t, g, unknown or other
  misc_feature (281)..(281): n is a, c, g, or t
  modified_base (390)..(390): a, c, t, g, unknown or other
  misc_feature (390)..(390): n is a, c, g, or t
  modified_base (420)..(420): a, c, t, g, unknown or other
  misc_feature (420)..(420): n is a, c, g, or t
  modified_base (480)..(480): a, c, t, g, unknown or other
  misc_feature (480)..(480): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttaattttaaaggtgtcaagtgtgcggtgaaggtattggagtcgtgggggaggcttggtacgaggccggggggtccctgacactctcctgtgcagcctctggattcacngtcagcagcaatgccatggtagttcggcccgccaggtcctaccgaggggaaggggtttgcgtaggtcggggtcgtcgggggtattaggggaagtggagtggtcgcccanacacgtacgcagcctcggtggacggggccncgttcatcagtctaccgagacgaacgtactaccgaaaacacctaagagtaactcgtaganaaagtacgacacgtaccctcgacgccgaccggaacggacccgaaccggtccgttaccgtaacctttccgtacgttacgaacccgttaaaacgtccccgttaacgtttttacggtttttaccggggcccggtaccggtaccccggtaacccgg

SEQ ID NO: 357392 - DNA, 688 bp, Homo sapiens
  misc_feature: GZ8MTXP02FLT2O.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctaggtacccaacaaccacccaggaccaaacccccccaactcatcatttatgtgtcactcgtcggccctcaggagtctcctcactcgcttctcacggtcctccaaagtctcggactaacaccggtccctacccctaaaccacttcctcgtcggggcctcccgtagttttggacgggtaccgagttccttaactttacttaacctacggtccttaaagttttacccgttttaaaagtttacgggtaccgtacccctaaccgttcgttacccggtttggggtttttcccggggaccggggttaacgggacccgtaaacccggtaaacggttaccggtaacccggttcccggttaccgggtaccgtaccggaaccccgtaaacgggtccgttcccggccccccgttaccggtaccctacccgtttccccg

SEQ ID NO: 357393 - DNA, 760 bp, Homo sapiens
  misc_feature: GZ8MTXP02JI198.22.36.D03.1.454.CMB.2.raw
  modified_base (321)..(321): a, c, t, g, unknown or other
  misc_feature (321)..(321): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtagaaggtattggagtcgtgggggaggcgttgggtacgagggccggggggtccctggacactctcctgtgcagcctcgtggattcacagtcagcagcaatgacccagtggtacggtttcgggccccnccgtaagggccgtaccggaagggggtaaggggttggaccggtaggggttcggggtcggtacgggggtagttaggggaaaggtgagtgggtacgccaacactacgtacgcgtaacggacctccgggtagggccgggggccctcgtttacgacgttacctacgtcccgttaccgacggaagtaaccgtaaccgttaaacccggaaaaactacccgtaagtacgtaaacttcccgtaaagtaaccgtaaaagtaccggttaacccgaacgacccgttaaccgaccgggtacccggtacccgggaacggtaccccggaacccggtccgttaccgttaaccggtttcccgtaggtaccggtaaaccgtaaaacgttccccgttacgtttaccggtttcgggacccgttccgggaccgtacggtaccggtcgggacccgtaccgg

SEQ ID NO: 357394 - DNA, 632 bp, Homo sapiens
  misc_feature: GZ8MTXP02GJ9RN.22.36.D03.1.454.CMB.2.raw
  modified_base (283)..(283): a, c, t, g, unknown or other
  misc_feature (283)..(283): n is a, c, g, or t
  modified_base (338)..(338): a, c, t, g, unknown or other
  misc_feature (338)..(338): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggagcgttggtacgagggcccggggggtcctgacactctcctgttcagccctcgtggattcanagtcagcagcaatgccatgaggttggtccgcaggctccggaggggtaaggggttncgtaggtgggtcgtaggggtattagggaagtggagttgggtcgaccaacacactacggcagaccgtccggtaggacgggccgtcttcgactcgactcctacgacgacgaacgtacttaaccgaaaacacgaacgtagtaactcgtacaactaaattacgtacacgtaccctacgacggaccgaccgaacggaccgaaccggtccgtaccgttaacgttcgtacgtacggaaccgaaacgtaaccgttacgttaacggttttccgggaccggtccggtacccgtacgtaaccggg

SEQ ID NO: 357395 - DNA, 596 bp, Homo sapiens
  misc_feature: GZ8MTXP02HHG2A.22.36.D03.1.454.CMB.2.raw
  modified_base (241)..(241): a, c, t, g, unknown or other
  misc_feature (241)..(241): n is a, c, g, or t
  modified_base (324)..(324): a, c, t, g, unknown or other
  misc_feature (324)..(324): n is a, c, g, or t
  modified_base (358)..(358): a, c, t, g, unknown or other
  misc_feature (358)..(358): n is a, c, g, or t
  modified_base (424)..(424): a, c, t, g, unknown or other
  misc_feature (424)..(424): n is a, c, g, or t
  modified_base (469)..(469): a, c, t, g, unknown or other
  misc_feature (469)..(469): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcctacgtcgggaacccaacgngtagactagttgggttctttgactctgtcctcgtcggtaaccaacaaccacccaggaccccaaacccccatcatctatttagngtcgtcacgtcgccggccctgacgtgtctcctcncgtcgtacttctcgacgtcctcctaacgtcgtacgaccaacgaccgtacccctaccctaaaccgtntcctcgtcggcctccgtagttgaaggtactagtcttacttacttngttctacgttacctttaaagtacggctcctacgtcgttcggttggtttcggacggtacgccgtacgtaacggtctaccgtcgtcggtcacggcccgacgcctccggcccctcggtcctaccgttccg

SEQ ID NO: 357396 - DNA, 620 bp, Homo sapiens
  misc_feature: GZ8MTXP02FV6O4.22.36.D03.1.454.CMB.2.raw
  modified_base (303)..(303): a, c, t, g, unknown or other
  misc_feature (303)..(303): n is a, c, g, or t
  modified_base (327)..(327): a, c, t, g, unknown or other
  misc_feature (327)..(327): n is a, c, g, or t
  modified_base (366)..(366): a, c, t, g, unknown or other
  misc_feature (366)..(366): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggctattttaaaaggtgtcaagtgtgcggtgaaggtattggagtcgtgggggagcgttggtacgaggccggggggtccctggacactctcctgtgcagcctctggattcacagtcagcagcaatgccatgagttggccncgaggctccggaggggtagggttncgtaggtgggtcgtcgggattgggaagttcgagtgggcnccaactacacgacgcagacgtcgaggcggggcccttctcatcactccacgaaggacgtaacgtaactaaaccgaaaatcgaagtataacgtcaagaactaagtacgtacgacgaccgtacgacgaccggaccgacggaccgaccgtaccgtaccgttacgttacgtacgtacgtaacgtaaccgtaccgttacgttacggttccggtccggtaccggtaccggtaccggtaccggtaccgggtaccggtaccgg

SEQ ID NO: 357397 - DNA, 1013 bp, Homo sapiens
  misc_feature: GZ8MTXP02F09K9.22.36.D03.1.454.CMB.2.raw
  modified_base (317)..(317): a, c, t, g, unknown or other
  misc_feature (317)..(317): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggtcttaattttaaaaggtgtcaagtgtgcggtgaaggtattggagtcgtgggggaggtcttggtacgacgggcccggggggtccctgacactctcctgtgcagcctcgtggattcacagtcagcagcaatcgccatggaggtttcgggtcccnccgaaggccttaccggaagggggtaacggggtttcggacgtaggggttcggggttaccggttcgggggtaagtttaggggaaaaggttggaaggttcggggtcgaccccgtaaccgtaaccgaacccgttaacccgcgtaaaccggtacccgggttaccccggggttagggggaacccgggggggtccccctttccggttttaaccaaacgtttacccgttaaaccgtttacccggttaacccccggaaaggggtaaaccccgggtaaaacccgggttaaaccgtttttaaaacccccccggggaaaaaaaaaccctaccccggttaaaacggggtttaaagggttaaaaacctttacccggttaaacgggtaaacctaaaaaccggtttacggttaaacccggaaaccgtacccccgttaaccgaacggggacccccgggaacccggggaaacccggggtaaccccgtaaacccccgggggttcccccgtttaaccgtttaaacccggttttcccggttaacggggtttaacccggaaaacccggggtttaaaaacccgttccccgttttaacccggtttttttaacgggggtttttaacccccgggggcccccggggtaccccggggttaaccccccgggtaaaccggtttacccgggggacccgggggtaccccgggttaaaacccccggggg

SEQ ID NO: 357398 - DNA, 653 bp, Homo sapiens
  misc_feature: GZ8MTXP02HLYB2.22.36.D03.1.454.CMB.2.raw
  modified_base (218)..(218): a, c, t, g, unknown or other
  misc_feature (218)..(218): n is a, c, g, or t
  modified_base (261)..(261): a, c, t, g, unknown or other
  misc_feature (261)..(261): n is a, c, g, or t
  modified_base (652)..(652): a, c, t, g, unknown or other
  misc_feature (652)..(652): n is a, c, g, or t
tcagacatacgcgtcacgaccggtgctcgatttagctgcgtcacgatctctcttggggttttggggggggtccctgacactctcctgtgcagcctctggattcacagtcagcagcaatgccatgagttgggtccgccaggctccgaggggaaggggttgcaggtgggtcgtcgggggattgggaagtgagtggtgccacacactacgcagacctccgnggagggcctcttcatcatctccagagacgtattaccgaaaacncagtagatctgacaaatgtacagcctcaggcgaccgagaccacggccgtactactctgtgacgaaagtacctcgttagttttcgggccgcggccgacctacggtcggggtccgacgggcctacccggtcggtccgacccgttctcctttccgaaccgtccctaccgacccgaaccggggacccacgttcgtccccttcccccgtcggcccgtccccgtgaccctaccgacgggaccgaccgaccccgtaccgacgacgacgaccgaccggcccggccccgtacgggccgttcgccggttacggtccgaaacggtacctacccgttaccgacggtaccgttacgtcgtactgggaaccggccgggtgacgggaccgaaggccgtacggaagng

SEQ ID NO: 357399 - DNA, 669 bp, Homo sapiens
  misc_feature: GZ8MTXP02FZK7Y.22.36.D03.1.454.CMB.2.raw
  modified_base (219)..(219): a, c, t, g, unknown or other
  misc_feature (219)..(219): n is a, c, g, or t
  modified_base (253)..(253): a, c, t, g, unknown or other
  misc_feature (253)..(253): n is a, c, g, or t
  modified_base (503)..(503): a, c, t, g, unknown or other
  misc_feature (503)..(503): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtggaggggccncttcatcatctaccagagacgattaccgaaaacncagtagaatctgacaaatgtacagcctcacgcgacgaggacacggccgtctacttctgtcgacgaaagtcctcgtttagttttcggggccgaccgggccgtaaccgtaccgtcggggccgaacggggtccctaccccgttcggtcccgtaaccggttccttcttaccgaccgtccctacccgaacccgaacggggccctacgtcccgttcccttcccccgtggccccaccccgttgcccgtccgaaggcnccgtaccgccggagacgcctaacgcggtcccggccgtggggccttcggcccgttaggggactaaaacgggtccttaccgtttacccggacgtaccggtttagtccggtacgtacgggtacggcccggggttacgccgggacggaacggggcctacggtaaacgtcg

SEQ ID NO: 357400 - DNA, 623 bp, Homo sapiens
  misc_feature: GZ8MTXP02FG51Y.22.36.D03.1.454.CMB.2.raw
  modified_base (218)..(218): a, c, t, g, unknown or other
  misc_feature (218)..(218): n is a, c, g, or t
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
  modified_base (402)..(402): a, c, t, g, unknown or other
  misc_feature (402)..(402): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctggtaccaacaacacccacggaccaaacccccccaactcatccatttatgtntcactcgtcggccctcaggcgtctcctcatcgcttcncacggctcaacgtctgacaacgacgccctacccaaccatcctctgggctcngtttgaggacgagtctacttattactcgactacggtttaccctttaaattacggtcgtaccctacgttccgttcggtttcggggtttttacggggaccgggtacgggacccaaccgggtaaacgtcggtaaccccggttccgttaccggggtaccaacccgggtcccctaaacggggtcccttacccggtcccccccgtcgggttacccacctttccccgg

SEQ ID NO: 357401 - DNA, 757 bp, Homo sapiens
  misc_feature: GZ8MTXP02HDHU9.22.36.D03.1.454.CMB.2.raw
  modified_base (192)..(192): a, c, t, g, unknown or other
  misc_feature (192)..(192): n is a, c, g, or t
  modified_base (448)..(448): a, c, t, g, unknown or other
  misc_feature (448)..(448): n is a, c, g, or t
tcagacatacgcgtcacgaccggtgctcgatttagctgcgtcacgatctctcttggggagctctgagagaggagcccagccctgggattttcaggttgttttcatttggtgatcaggactgaacagagagaactcaccatggagtttgggctgaagtggtcttttgcttgtggcttaattttaaaaggtgtnaagtgtgcggtagaaggtattggagtcgtgggggagcttggtacgagggccggggggtccctggacactctcctgtgcagcctctggacttcacagtcagcagacaatgccatggtagttcggcccgccgaggcctaccggagggggtaaaggggttgacgagggttggggtccgtagggggatttaggggaaaggttggaagtggggtacgacccgacaaccgaacgtaccgacgaacggaccgttaccccgggnggggacgggggtcccgtaccgtttacactacctaacttacccgtaccccaaaggaaacggaaccggtaaaccttaaaccccgggaaaaaacaaaccaaaggtaaggtaaaacttacgacggtaactaaaagttacgaaacgaccggaccctaccgacggacccggaccggaaacgggtaacccggacccggggtacccgttaccgttaaccgtttacgtacgttacggaaccggtaaaaaccgtacccgtttaacccggtttaggtttttaccggggcccccggtaccgggtaccccggtaaacccggg

SEQ ID NO: 357402 - DNA, 679 bp, Homo sapiens
  misc_feature: GZ8MTXP02FP4Z1.22.36.D03.1.454.CMB.2.raw
  modified_base (186)..(186): a, c, t, g, unknown or other
  misc_feature (186)..(186): n is a, c, g, or t
  modified_base (188)..(188): a, c, t, g, unknown or other
  misc_feature (188)..(188): n is a, c, g, or t
  modified_base (293)..(293): a, c, t, g, unknown or other
  misc_feature (293)..(293): n is a, c, g, or t
tcagacatacgcgtcacgaccggtgctcgatttagctgcgtcacgatctctcttggggagctctgagagaggagcccagcccctgggattttcaggtgttttcatttggtgatcaggactgaacagagagaactcaccatggagtttgggctgaagtggcttttgcttgtggctattttaaaaggntnaagtgtgcggtgaaggtattggagtcgtgggggagcgttgggtacaggccggggggtccctggacactctcctgttcagcctcgtggtattcacagtcagcacgnaaacgtgaccagtggtaggttcggggtcccgccgaggcctaccgaggggtaacggggttcgacgtaggtcgggtcgtcggggtattcgggaaagtggaagtggtcgaccgacacgacgtacggcaacgaccgtccggtaggacggggcccgtcttacacgtcactcgtaccgacgtaacgacgtaacgttacccgaaaacacgtaacgtagtaactacgtacgaacgaaactacgtaacgaacggtcctacgaccggacggaccggaacggaccgtacggtacccggttactttaaccgttcgtacgttacggaaccgtaaaacgtaacccgtttacgttacggttttcggggccccggttacggacccggtaccgttaaccgggg

SEQ ID NO: 357403 - DNA, 617 bp, Homo sapiens
  misc_feature: GZ8MTXP02FTC7I.22.36.D03.1.454.CMB.2.raw
  modified_base (261)..(261): a, c, t, g, unknown or other
  misc_feature (261)..(261): n is a, c, g, or t
  modified_base (410)..(410): a, c, t, g, unknown or other
  misc_feature (410)..(410): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggagcgttggtacgaggccgggggtcctgacactctctgngcagcctctggattcacagtcagcagcaatgccagtggagtttcgggccgccgaggccgtaccggaggggtacggggttgcgtagggtgggtacggtggggtattgggagtgagtggtcgaccacgacacgtacgcacgtacctcgggngggaccggggtcctcttcgactctacgtcctacgaggacgtacgaacgttaaccgaaaacacgtagtacgatcgtagactaagcgacacgacgactacgacgaccggaccggacggaccgtacccgggtccttaccttaacgttcgtacggttacgaacgtaaacgttaccttacgtttacggtttaccggacccgtcggtaaccgg

SEQ ID NO: 357404 - DNA, 696 bp, Homo sapiens
  misc_feature: GZ8MTXP02FHDPU.22.36.D03.1.454.CMB.2.raw
  modified_base (201)..(201): a, c, t, g, unknown or other
  misc_feature (201)..(201): n is a, c, g, or t
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
tcagacatacgcgtcacgaccggtgctcgatttagctgcgtcacgatctctcttggggggggtctcaggaggcagcgctctctggacgtctccaccatggcctgggctctgctattcctcaccttcctcactcgagggcacagggtcctgggcccagtctgccctgacccagcctgcctccgtgtctggatcatctggacngtcatcagctatttccngctacgtacggaaccaagngtcgaactggttcggttctttgactcgtctcctcgtacgaaccaacaaccacccgacgaaccccaaaccccctatacactatatttagtcgtctacaccgtccgccgtcctacgagtactctccctacgactcgtcttcacgacgtcctaccgaaacgttcgtaccgaccaacgtacccggtaccccttaacccgtaacctaccgttccgtccggtcggaccctttaccggtacgtttacggaacggtacgttacgttacctttaaccgtttaataccgttcgtaacctttacctttaaccgtttaaagaccgtaccctaccttacgttccgttcgggttacggtttccgggacggtacgaccgtaaacgggtacgtaccgtccgggtaccgtacgtacgacccgtaacccggacgtcccgtacccgtaccccgttacggacccttccggttacccccg

SEQ ID NO: 357405 - DNA, 610 bp, Homo sapiens
  misc_feature: GZ8MTXP02I7JHX.22.36.D03.1.454.CMB.2.raw
  modified_base (303)..(303): a, c, t, g, unknown or other
  misc_feature (303)..(303): n is a, c, g, or t
  modified_base (429)..(429): a, c, t, g, unknown or other
  misc_feature (429)..(429): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatcgccatgagttgggtcccnccaggcctccgaggggaaggggttgcgtagggtcgggtacgtcggggtatttgggaaaggtgagttcgggtacgcccaacgaccaacgttacgcgacgacccgttccgggaggaccgggggtcccncttacgatctactcctacgagacgacgtacttaaccgaaaacacagtacgaatcgtagactaaagtcgtacacgccacgacgccgacgacggacgacggcctacgttactcgtcgtacgacgaacgtaccgttcttacggttttcggccgtacggaccgacgtacggtcgggaccgaccgg

SEQ ID NO: 357406 - DNA, 540 bp, Homo sapiens
  misc_feature: GZ8MTXP02FOIM0.22.36.D03.1.454.CMB.2.raw
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
  modified_base (319)..(319): a, c, t, g, unknown or other
  misc_feature (319)..(319): n is a, c, g, or t
  modified_base (338)..(338): a, c, t, g, unknown or other
  misc_feature (338)..(338): n is a, c, g, or t
  modified_base (378)..(378): a, c, t, g, unknown or other
  misc_feature (378)..(378): n is a, c, g, or t
  modified_base (395)..(395): a, c, t, g, unknown or other
  misc_feature (395)..(395): n is a, c, g, or t
  modified_base (456)..(456): a, c, t, g, unknown or other
  misc_feature (456)..(456): n is a, c, g, or t
  modified_base (534)..(534): a, c, t, g, unknown or other
  misc_feature (534)..(534): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgactattggtcttttgactctgtctctgtaccaacacaccagaccaaacccccatcatcatttangtntcactcgcggcctcngagtctcctcatcgtctcncagctacaagtctagaccaacacgaccctaccctaaaccntcctcgtcggcttaccngtttacgagtacgagtcttaacttactatcgctagtttaccgtttaaattcggactacctnttctcggttggtttcgacggtagacgacgacgtcgcccgtctacggcacggaacccaaggcctcgtaccccgcgtacncgtccc

SEQ ID NO: 357407 - DNA, 681 bp, Homo sapiens
  misc_feature: GZ8MTXP02J1DSA.22.36.D03.1.454.CMB.2.raw
  modified_base (308)..(308): a, c, t, g, unknown or other
  misc_feature (308)..(308): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcgttggtacgaggccggggggtcctgacactctcctgtgcagcctctggattcacagtcagcagcaatcgaccagtgaggttcgggtcccncgaggcctccgaggggtagggttgcgaggtggggtcgtcggggtattgggaacgtgtagtcggtcgacccaacgacacgttaccgcaacgtaccgtccggtagggaaccgggggtccctacttacgactaccgtactcccgtaccgtaaggaacgaacggtaacttaaacccgaaaaacgaccgtaagtaacgtaaactcgtacgaacgtaaaattcggtaaccacggtaccctacgaacggacccggaccggaacggaacccgaccggtcccgtacgtaccgttcgtacggtacgaaccgtaaacgtacccttacgtttaacgtttccggggaccgtaccgggaccctacgtccggtaccgggccgaccggg

SEQ ID NO: 357408 - DNA, 619 bp, Homo sapiens
  misc_feature: GZ8MTXP02JP3JR.22.36.D03.1.454.CMB.2.raw
  modified_base (393)..(393): a, c, t, g, unknown or other
  misc_feature (393)..(393): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
tcagacatacgcgtcacgaccggtgctcgatttagctgcgtcacgatctctcttggggggagagaggagcccagccctggggattttcaggtgttttcatttggtgatcaggactgaacagagagaactcaccatggagtttgggctgaagtggcttttgcttgtggctattttaaaaaggtgtcaagtgtgcggtgaaggtattggagtctgggggaggcttgggtacaggccgggggggtccctgacactctcctgtgcagcctctggattcacagtcagcagcaatgccatgagttgggtccgcaggctccaggggaaggggttgcagtggggtctcggggattggaagtgatggtgccacacactacgcagactccgtgacgggggccncttccatcatcctcagacgacgacttaccgaaaacanagtanaactctagaactaaagtgtaacgacgacctcgacggcggaccggacggtaccgaccggtcccgttaccttaccgttcgtacggtaccggaaaccgtaaacggtacccttaccgtttacggttttcccgggggcccgtaccggggtacccgtacgttacccgggtcgggggacccggtaacgggg

SEQ ID NO: 357409 - DNA, 619 bp, Homo sapiens
  misc_feature: GZ8MTXP02I5AO0.22.36.D03.1.454.CMB.2.raw
  modified_base (468)..(468): a, c, t, g, unknown or other
  misc_feature (468)..(468): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaaggtgtcaagtgtgcggtgaaggtattggagtctgggggaggcttggtacaggccgggggggtccctgacactctcctgtgcagcctctggattcacagtcagcagcaatgccatgaggtttgggtcccgccgagggctacccgaaggggaaggggttgacgagggttgggtcgtcgggggaattggaaaggtgatcggtgccacgacaactacgcacgactccggtgacgggggcctcttcatcattcaccaaggacgaaagtacttaaaccgaaaaacacaaaggttaanaactactacgtaactaaatacgtaacgacgacctacgacgaccgaccggacggacgaccgtaccgtactacttctacgtacgaacgtaaacgtaactacgtttacgtttcggtccggaccggtaccggtacgtacggtacgggacggacgg

SEQ ID NO: 357410 - DNA, 574 bp, Homo sapiens
  misc_feature: GZ8MTXP02IA59T.22.36.D03.1.454.CMB.2.raw
  modified_base (218)..(219): a, c, t, g, unknown or other
  misc_feature (218)..(219): n is a, c, g, or t
  modified_base (231)..(231): a, c, t, g, unknown or other
  misc_feature (231)..(231): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
  modified_base (422)..(422): a, c, t, g, unknown or other
  misc_feature (422)..(422): n is a, c, g, or t
  modified_base (533)..(533): a, c, t, g, unknown or other
  misc_feature (533)..(533): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcaggcacagggtcctgggcccagtctcgccctgacccagcctgcctccgtgtctgatcatcgtggacagtcgatcagcatttccnncagtggaccaanagtgactagttggtctttgctctgtctctgtacaacacaccacgacccaaccccatcatcatttngtntcactcgtcgccncgaggctctccncactcgctctcgacgctacaagtcgtacgacctaaccgaccgtacccctaccctaaactctccctcgtcgggtccttacgtaggtttcgagtaccgtntacttacgttacttccagttacttactttaccttaaaagttcgccaccgttactcgtttacggttcggtttcggacggtacgctacggtaactccggacgttcgccgtacncgtaaccgacgtccgcgtaccccgtcggtacctacgttccc

SEQ ID NO: 357411 - DNA, 662 bp, Homo sapiens
  misc_feature: GZ8MTXP02GW6I4.22.36.D03.1.454.CMB.2.raw
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
  modified_base (259)..(259): a, c, t, g, unknown or other
  misc_feature (259)..(259): n is a, c, g, or t
  modified_base (316)..(316): a, c, t, g, unknown or other
  misc_feature (316)..(316): n is a, c, g, or t
  modified_base (363)..(363): a, c, t, g, unknown or other
  misc_feature (363)..(363): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacgagggtcctgggcccagtctgccctgacccagcctgcctccgtgtctggatcatcgtggacagtcgatcagctatttccngcacgtcggaccaagngtgactgttggtctttgactntcgtctccgtacgtaccaacaaccaccacgaaccccaaacccccatcatctattagngtactcactcgccgcctagacgtactctctactatcgtacttcacgngtcctacaagtcgacgtaccaaccgtccgtaccctaaccctaacctactacccgtggtaccggtcctaccgtaggtttacggacggtacgtacttaccttaaagttacttaaccgtacgttaacgttacgttttaacctttaaaggaccgtaaccgttcccgtaaccgttcgttcggggtttaccggtttacggggaccgttaacggaccgtaaacggttacgtaccgggtaccttccggtacgtacgaccgtcccgtaacggtccccgtccgtacccgtacggtcctaccgtttcccg

SEQ ID NO: 357412 - DNA, 655 bp, Homo sapiens
  misc_feature: GZ8MTXP02FTSAX.22.36.D03.1.454.CMB.2.raw
  modified_base (366)..(366): a, c, t, g, unknown or other
  misc_feature (366)..(366): n is a, c, g, or t
  modified_base (406)..(406): a, c, t, g, unknown or other
  misc_feature (406)..(406): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtcctgacactctcctgtgcagcctctggattcacagtcagcagcaatgccagtgagttgggccgccaggctccgaggggaaggggttgcgaggtggggtcgtcggggattgggaaagtggagtgggtacnccgacacacgttacgcgagactccggtaggacgggggccncgttcactcacttcgtccaaggacgtacgtacgttaacccgaaaactaccgaagtagaaacttacgtaaggaacctaaaagttacgttaaccgaaggcccctacgaacggcccgggaccgggaaggaccgtaccggggtcccttacgtaccgtttccgtgggttaccgaaccggtaaacgtacccgtaccgtttaggttttccggggccgtaccgggaccgtaccgtacgggtacgggccgaaccgggg

SEQ ID NO: 357413 - DNA, 791 bp, Homo sapiens
  misc_feature: GZ8MTXP02I0ZEM.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggctttgcttgtggcttattttaaaggtgtcaagtgtgcggtgaaggtattggagtcgtgggggaggcttggtacgagggccggggggtccctgactctctcctgtgcagcctctggattcacagtcaggcaagcaatcgaccagtggtaggttcgggtacccgccgtaagggccgtaccggagggggtaacggggttcgaccggtaggggttcggggtccggttagggggtacttaggggaaagggttggtaagttcggggtaccacccccggacgtaaccgtaaacccggttaccggaccgaacggggtacccgtttacccgggggtacggggtaaccggggggccccttaccggtttccgaaacgtccctaaacttcccgttaaccccgaagggtaacccgtaaccggtaaacttaaccccggaaaaaacttaccggtaacggttagtaaaacttcccgtaggtaaacccaaaagttccggaacaaccggtcctaccgaacggccggaccggaaaacgggccgtaacccggggtccttaacggttacctttcgtacgggtccgtaaacggtaaaccgtcccgttaaagttttacgggtttaccgggcccggtaccggttcggtaaaccccgg

SEQ ID NO: 357414 - DNA, 565 bp, Homo sapiens
  misc_feature: GZ8MTXP02H207M.22.36.D03.1.454.CMB.2.raw
  modified_base (237)..(237): a, c, t, g, unknown or other
  misc_feature (237)..(237): n is a, c, g, or t
  modified_base (318)..(318): a, c, t, g, unknown or other
  misc_feature (318)..(318): n is a, c, g, or t
  modified_base (334)..(334): a, c, t, g, unknown or other
  misc_feature (334)..(334): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (481)..(481): a, c, t, g, unknown or other
  misc_feature (481)..(481): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcgatctggacagtcgatcagcatttcctgcactgggacccaatagngactagttggtcttttgactctgtctcctggtaccaacaaccacccacggaccccaaaccccccaatccatcatttatgtntacactcgtccgcctnaggtatctcctcacgtcncttcncagcctacaagtcgtgaccaacgacgcccttacccaacatctacgtcgggaccttccgtaagtttcgagtacgtagtctaactttacgttactggtactacgtttactttaaacgtcggtaccnctacgtcgttcgttggtacgcggtacgccacgtacgtacgccgtcgtcgtcacgtaaccgacgcctccgaccctcgcctacgtc

SEQ ID NO: 357415 - DNA, 694 bp, Homo sapiens
  misc_feature: GZ8MTXP02HKOXO.22.36.D03.1.454.CMB.2.raw
  modified_base (327)..(327): a, c, t, g, unknown or other
  misc_feature (327)..(327): n is a, c, g, or t
  modified_base (358)..(358): a, c, t, g, unknown or other
  misc_feature (358)..(358): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggtcttgggtacgacgggtcccggggggtccctggaccacttctccgtgtgacagtcctctggattcacagtcagccagcaatcgccatggtaggttcggcccnccgaggcctaccggaagggggtaggggttcncggtaggtcggggtcggtacggggagtttaggggaagtggagtgggtccgacctacacgtactacggacacggaccgtccgggtgggacgggggtcctacttcatacgaactcctacccgaaggacgtaacccggaacttaacccggaaaaatccgaaagtacgtaactccgtagaactaaagtcggtaacaacggtcctagacggaccggaccggaaacggtacccgaccggtaccccgttagttaaccgttccggtaggtaccgtaaccgtaaaagttccccgtttaagtttacggttttcccggggcccggtaccggtaccggttaaacccgg

SEQ ID NO: 357416 - DNA, 681 bp, Homo sapiens
  misc_feature: GZ8MTXP02F3V4I.22.36.D03.1.454.CMB.2.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcatcagctatttccngcacgtggaaccaacagtgactagttgggttcttttgacttcgtcgtcctctacggtaccaacaaccaccgacgaccccaaacccccatcatctattagtgtctctaccgtcgtccgtccctagaggtacttctcccgtcacttcgtcctttcgtaccgacgtcctaccgtacgtcgtacgacctaaccgacccgtacccttaccctactacttccgtcgtcggcctacgtggttagacgtacgttacgttacttaacgtttacttcgtacgttaccggtttacttttaaaccgtttaaacggtcccgtacgtaccgttcgtttccggttagggtttccgggtttcgggacggtaaccggtaccgttaaacggtaccgggttaccgtacccggttccgtaccggtaccgaccgaacccgtacgtcccggtccccgtccccgtacgtcccgtactttcccccgg

SEQ ID NO: 357417 - DNA, 555 bp, Homo sapiens
  misc_feature: GZ8MTXP02FRYE9.22.36.D03.1.454.CMB.2.raw
  modified_base (304)..(304): a, c, t, g, unknown or other
  misc_feature (304)..(304): n is a, c, g, or t
  modified_base (363)..(363): a, c, t, g, unknown or other
  misc_feature (363)..(363): n is a, c, g, or t
  modified_base (391)..(391): a, c, t, g, unknown or other
  misc_feature (391)..(391): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccgggggggtccctgacactctcctgtgcagcctctggattcacagtcagcagcaatgccatcgagttgggtccncgaggctccgagggagggtgcaggtgggtctcggggtattgggaagtgagtggtgccanacactacgcagactcgtgacgggggccnttcatcactctccagagacgattaccgaaaactacagtagaaatctagacaaatgtaacagccctcacgcgcgaggacacggccgtctacttctgtacgacgaaacgtacctacttacgttttcgggccgaccggccgtaccgtacgtcggggccgtaccgggg

SEQ ID NO: 357418 - DNA, 592 bp, Homo sapiens
  misc_feature: GZ8MTXP02IUU0F.22.36.D03.1.454.CMB.2.raw
  modified_base (308)..(308): a, c, t, g, unknown or other
  misc_feature (308)..(308): n is a, c, g, or t
  modified_base (329)..(329): a, c, t, g, unknown or other
  misc_feature (329)..(329): n is a, c, g, or t
  modified_base (346)..(346): a, c, t, g, unknown or other
  misc_feature (346)..(346): n is a, c, g, or t
  modified_base (368)..(368): a, c, t, g, unknown or other
  misc_feature (368)..(368): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtctttgactctgtctctgtaccaacaacaccagacccaaaccccccatcatctatttatggtntcactcgtcggccctcgaggntctcctcatcgtcttcncgacgctccaagtctgccaacnccggtccctaccctaaacctatcctcgtcgggtcctaccgtagtttaggacggtacgtacgtcttaactttacttctacgtacgttacgtttacctttaaagtaccgggtctaccctacgttcgttcggttggtttcggcggtacggccgtaccgtaggtcgtacccgtccgtaccggtcaccggtcccgaacggtcctccgccccgtcggtcctacgttcccg

SEQ ID NO: 357419 - DNA, 696 bp, Homo sapiens
  misc_feature: GZ8MTXP02IZ78R.22.36.D03.1.454.CMB.2.raw
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgaccagcctgcctccgtgtctggatcatctggacagtcgatcagctatttcctgcacgtagggaccaagtagtgactagttggtcttttgacttctgtctcctgtaaccaacaacacccacgaccaaacccccatcactctattangtntctactcgtcgcctacgagtactctcctcatccgtcttcgcacggcctacgtaaagtccgtacgaccaacgaccggtacccctacccctaaaccacgttacccgttcgtcgggtccttaccgtacggtttacggaaacgggtaccgtaggtttacccttaagtttaaacgtttaccgttacgttaccgtttaacgttttaacctttaaaacggtttaccggtacccggtacccttaaccggtttccgttacggggtttccggggttttacggggaccgggttacgggaacccgtaaccgggtaaacggtcgttaacccggtcgtaccggtaccgaacgaaccgaaccggtcgtaccccgcccgtacgtccgtacgtttcccg

SEQ ID NO: 357420 - DNA, 646 bp, Homo sapiens
  misc_feature: GZ8MTXP02HAEQ5.22.36.D03.1.454.CMB.2.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (312)..(312): a, c, t, g, unknown or other
  misc_feature (312)..(312): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctcgccctgacccagcctgcctcgtgtctggatcatctggacagtcgatcagtctattccngctacgtcggaccaangtagactagttggttctttgactctgtctcgtagtaccaacaccaccgacgaccccaaacccccatcactctaattntcggtacgtctacgtccgtccggccctagtagtacgtctcctcactctcttctacgacgtcctaccgtaacgtcgtacgacctaaccgccgtacccttaccctaactcctcgtcggtacggtccttacgttagttggaacgtacgtagttccttacttacttacgtcgtacgttacgtttaccttaaagtcgacctactacgttcgttcgggttacggtttcggacgggtacgtacccgtacggtaaacgtccgtaccgttcccgacggttaccgaaccggtcccgtaacggtcccgtacccggttccccgtacggtacctcccggtttacccg

SEQ ID NO: 357421 - DNA, 627 bp, Homo sapiens
  misc_feature: GZ8MTXP02JRVBY.22.36.D03.1.454.CMB.2.raw
  modified_base (311)..(311): a, c, t, g, unknown or other
  misc_feature (311)..(311): n is a, c, g, or t
  modified_base (435)..(435): a, c, t, g, unknown or other
  misc_feature (435)..(435): n is a, c, g, or t
  modified_base (462)..(462): a, c, t, g, unknown or other
  misc_feature (462)..(462): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggcttgggtacgagggccggggggttccctgacactctcctgtcgcacgtcctctggattcacagtcagcagcaatgcagtgaggtttcggccncgaggcctcggaggggtagggttgcgaggtcggggtccgtggggtattgggaagtggagtggggtcaccacacgaccgtagcagacgtccggtaggacgggggccctcttcgactctacttccncgtaagacgacgacttaaccgaaaacncgatagaactctaaggactaaagtgtaacgacgcccttacgaaccggccggaccggtaacggacccgacggtcccgttactaccgttcgtacgtacgacgtaaaccgtccgttcgtttaacgttccggggacgtccggacctacgtacgggtcggaccgtacggg

SEQ ID NO: 357422 - DNA, 634 bp, Homo sapiens
  misc_feature: GZ8MTXP02GKDLJ.22.36.D03.1.454.CMB.2.raw
  modified_base (306)..(306): a, c, t, g, unknown or other
  misc_feature (306)..(306): n is a, c, g, or t
  modified_base (315)..(315): a, c, t, g, unknown or other
  misc_feature (315)..(315): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
  modified_base (380)..(380): a, c, t, g, unknown or other
  misc_feature (380)..(380): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacgagtgactagttgggttctttgactctgtctccgtgtaacccaacaaccacccacgaccccaaacccccancatctattnggtctcactcgccgtcctgagntctccncatcgtctcgacncgtctaccaagtcgtcgaccaacnccggtcccctacccacctacgtctcggtcggtctaccgtagttcgacggaacgtactacttaacgtttacttacgtagtacctttaagtttaccttttaaaagtacggtccgtacctacgtttccgttcggtttggggtttccggacgggtacggaccgtaaccggtaacggtcccgtacccggttaccgtccggttacgaaccgtaacgaaccggtccctccggtcccccgtacggtcctaccggtttccccg

SEQ ID NO: 357423 - DNA, 547 bp, Homo sapiens
  misc_feature: GZ8MTXP02IESRR.22.36.D03.1.454.CMB.2.raw
  modified_base (218)..(218): a, c, t, g, unknown or other
  misc_feature (218)..(218): n is a, c, g, or t
  modified_base (251)..(251): a, c, t, g, unknown or other
  misc_feature (251)..(251): n is a, c, g, or t
  modified_base (391)..(391): a, c, t, g, unknown or other
  misc_feature (391)..(391): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
  modified_base (438)..(438): a, c, t, g, unknown or other
  misc_feature (438)..(438): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgagggaaggggttgcagtgggtctcggggattggaagtgatggtgccacacactacgcagactccgtgaggggccncttcatcatctccagagacgattaccgaaaacncagtgaatctgcaaatgtacagcctcagcgccgaggacacggccgtctacttctgtgacgaaacgtaccttcttagtttttcgggccgcggccgaccgtacgtcggggccgagggccacccgtcggtcaccgtctcttcncgcctccacacggccatcgtcctcccngccnccctgctccgagcgcnccctcgacgcgcacgacgccggccgtcggctcgcctgtacacggtactaccttccgacgtcgtacgtcgtacgtcggacggccgggtcgtacggcgaacggcgacagag

SEQ ID NO: 357424 - DNA, 649 bp, Homo sapiens
  misc_feature: GZ8MTXP02F1Q1G.22.36.D03.1.454.CMB.2.raw
  modified_base (219)..(219): a, c, t, g, unknown or other
  misc_feature (219)..(219): n is a, c, g, or t
  modified_base (311)..(311): a, c, t, g, unknown or other
  misc_feature (311)..(311): n is a, c, g, or t
  modified_base (408)..(408): a, c, t, g, unknown or other
  misc_feature (408)..(408): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcactcgggaaccaacagtgactagttgggtcttttgactctgtctcctggtaccaacacaccacgaccaaacccccactcatctatttagngtcgtcactcgtccggccctcgagtatctcctcactcgcttctcgacggtcctacctaacgtcgtacgaccaaccgtaccggccctaccctaaaccncttcctcgtcgggtccttaccgtagtttggaacgtaccgtacgttcttaaactttacttacgtcgtacttacgttttaacccgtttaaagttaccggccgttaccctacgtttccgttcggtttcgggtttacgggcggtacggtacccgtaacggtacgtaccggtacccgttccgtaccggtacctaccggaacccgtacggtcccgtcccggtcccccgtggtccctacgtttccccg

SEQ ID NO: 357425 - DNA, 731 bp, Homo sapiens
  misc_feature: GZ8MTXP02FL878.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggcttgggtacgagggcccggggggtccctgacactctcctgtgcagcctctggtacttcacagtcagcagcaatgtcatggtaggtttcgggcccgccgacggctaccggaaggggtaaggggttcgcgtagggtggggtcggtacggggtagttagggaaggtgaacgtgggtcgaccaactacaaccgttacgcaacggaccgttcccgggaggggaccgggggtcccgtcttacgtactcctactacccgtaccgaaggaacgtaacgtaaacgtttaaaccccgaaaaaacgacgtaaacgtaagaaaacttcgtaacggaataaaacgttacgtaaccgacgtacccacgacggccgaccggacggaaccgccggtcccgttacgtacctttacgtaggttacgaacccgtaaacggttaccccttagtttaaccggttttccggggacccggtaccgggtacccggtaaaccggtttccggtaccgggggacccggtaacccgggg

SEQ ID NO: 357426 - DNA, 679 bp, Homo sapiens
  misc_feature: GZ8MTXP02IWRZV.22.36.D03.1.454.CMB.2.raw
  modified_base (300)..(300): a, c, t, g, unknown or other
  misc_feature (300)..(300): n is a, c, g, or t
  modified_base (314)..(314): a, c, t, g, unknown or other
  misc_feature (314)..(314): n is a, c, g, or t
  modified_base (329)..(329): a, c, t, g, unknown or other
  misc_feature (329)..(329): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgactagttggtcttttgactctgtctactcggtaccaacaccaccacgaccccaaacccccacncactcatttatgtntcactcgtcgccctnagntctcncatcgtcttcnccagtcctcgatcgacgccaacgccgtccaccctaacacttctcgtgggtcctacgtacggttagacggtaactacgtcgttaactttactttactggtacctttaaggtttacccgtttaaaaagtttccgggaccgttaacccctacgtttccgttaccgggttttcggggtttaccggggtacggtaacgggtacccgtaaaccggttaaacggttcccggaaaccccgtttcccggtaccggggtacctaccggtaaacccccgtaacggggtccccgtttaccccgggtcccccccgtttacccgggtacctacccggtttccccg

SEQ ID NO: 357427 - DNA, 616 bp, Homo sapiens
  misc_feature: GZ8MTXP02I09D1.22.36.D03.1.454.CMB.2.raw
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (317)..(317): a, c, t, g, unknown or other
  misc_feature (317)..(317): n is a, c, g, or t
  modified_base (333)..(333): a, c, t, g, unknown or other
  misc_feature (333)..(333): n is a, c, g, or t
  modified_base (357)..(357): a, c, t, g, unknown or other
  misc_feature (357)..(357): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctatttccngcactgggacccaacngtgactattggttcttttgacttctgtctcctggtacccaacaaccaccacggacccaaaccccccatcactcatttatggtntcactcgtcggccctnagtacgtctcctacatcgcttacncaggtcctaccgaagttcgtacggaccaacgtaccggtccctacccgtaactactccgtcgtcgggtcctacgtacgtttcgacggtacgacgtcttaacttacttacgtgtactagtttaccttaaatacgggcctacctacttcgtgttcgggttttcggacggtacggtctaaaccggtacggtccgtaccgttcccgtacggtccaacggaaccccgtaaggtccgtccgtcccccgtcggtcctactttcccgg

SEQ ID NO: 357428 - DNA, 746 bp, Homo sapiens
  misc_feature: GZ8MTXP02JBL7M.22.36.D03.1.454.CMB.2.raw
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcacatggagtttgggctgaagtggcttttgcttgtggtcttaattttaaaaggtgtcaagtgtgcggtgaaggtattggagtcgtgggggagtcttgggtacgagggtccggggggtccctgacgacctctccgtgtgcagcctntggatcacagtcngcagtcaatcgcctagtggtacggttcggggtcccgcccgagggccgttcccggaagggggtaacggggttcggtaccgtaggggttggggttcccggttagggggtagtttaggggaaagttggacggtttgggtccgaccgtaccgaacgtacgtacgacctaaccgggtacgtcccgggtgggaccggggtcccgtctttcgaacttcacgttccgtacccgaagtacgtaaccgaacgttaacccggaaaactaaccgtaggacgtaaacttaccgtgaaccgaaatcgtaacgaacgcccgtacgaggccgaccgggacgaaacccggtcggtacccgtcgttaaaccgttcgttacggggtaaccgtaacgtaaaccgttacccgtttaccgttttaacgggttttacccggggcccggttacccggggtaaccccggtttaacccggg

SEQ ID NO: 357429 - DNA, 617 bp, Homo sapiens
  misc_feature: GZ8MTXP02F4JOZ.22.36.D03.1.454.CMB.2.raw
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (304)..(304): a, c, t, g, unknown or other
  misc_feature (304)..(304): n is a, c, g, or t
  modified_base (395)..(395): a, c, t, g, unknown or other
  misc_feature (395)..(395): n is a, c, g, or t
  modified_base (414)..(414): a, c, t, g, unknown or other
  misc_feature (414)..(414): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcactgggaccaanagtgactagttggtctttgactctgtctctgtaccaacacaccagaccaacccccatcatcatttatggtntcactcgtccggccctgaggtacgtctcctacactcgtcttactcaggtcctaccgaagtcgtcgaccaacgaccgtccctaccaaacctntcctcgtcgggcctaccgnggtttacgacggtacgtacgttacttaacttagttactaggttacttactttaaaagttcgaccgtccgtacttcgttacggttcggttacggtacggtacggacgtaccggtaacgtacgtacccgttcgtaccgtacgaccgtacccgtaacggcccttaccggtcccccgtaccggttcctacccgttcgtttcccccgg

SEQ ID NO: 357430 - DNA, 822 bp, Homo sapiens
  misc_feature: GZ8MTXP02I5JLS.22.36.D03.1.454.CMB.2.raw
  modified_base (185)..(185): a, c, t, g, unknown or other
  misc_feature (185)..(185): n is a, c, g, or t
  modified_base (268)..(268): a, c, t, g, unknown or other
  misc_feature (268)..(268): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttggctgaagtggcttttgcttgtggctaattttaaaaggngtcaagtgtgcggtgaaggtattggagtcgtggggaggcgttggacgaggccggggggtcctgacactctcctgtgcagcctntggacttcacagtcagccagcaagtcgacctagtgtacggttcgggtcccgccgacggtccgtacccggaaggggtaaggggttcgtacggtaacggggttcggggttccggttacgggggtaaccgtttaggggaaaggttcgggtaggttcggggtaccgtaccctaccggtaacgaacccgttaaacggacccgtaacggtaacccgggtccgggtttacgggggaacccgggggtcccgttccgtttaccgtaacgttaccctacgttaccccgttaaccggaacgtaaacggtaaccgtaaacccgtttaaacccggaaaaaccgtaaacgtaaggttaaccgtaaaacgtttaccgaggtaaaccctaaaacggttacgtaaccgtaccggttacccgtaccgaacggcccggaaccggaacggtaacccggtacccgggtccccgttacgttaaccgttcgttacggttacgaaccggtaaaacgttacccgtttacggtttaacggttttccgggaccccggtacggtacccggtttaaacccggg

SEQ ID NO: 357431 - DNA, 608 bp, Homo sapiens
  misc_feature: GZ8MTXP02GMOVB.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaccaacagtgactagttggttctttgactctgtctcctaggtaaccaacaaccacccacgaccccaaaccccccatctactctatttatggtctcaccgttccgtccggtccctacgacggtacgttcctcctcacgtcgtccttcctcgtacggtcctacccgtaaagtccgtcggacccaaccgacccggtccccttacccgtaaccacctccgtacgtcggtacctccgtaggtttagacggtacgtagttacttactttagttactgtactagtttaccttaagtcgtctacctactcgttcgttggttacggcggtacgtcaacggcgtacgtcctcgacgtcacgcccgagcctccgcccgtcgcctacttcccg

SEQ ID NO: 357432 - DNA, 714 bp, Homo sapiens
  misc_feature: GZ8MTXP02FH3K4.22.36.D03.1.454.CMB.2.raw
  modified_base (281)..(281): a, c, t, g, unknown or other
  misc_feature (281)..(281): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggcttgggtacgacgggccgggggggtccctgaccactctcctgtgcagcctcgtggacttcanagtcagcagcaatcgaccatggagtttcgggtcccgccgaaggcctaccgaggggaaaggggtttcgacgaggtggggtcgtcgggggattggggaaagtggactgggtacgccaacacactacggccaggaaccctcgggttacggacgggggtcccgtctttacgtactcgtatcctaccgacgaacgtaaccgtacgttaaacccgaaaaacgtacgaacgtacgaaagtaccttaggaacctaaaagtacggttaacacgaccctaccgaaggcccgacccgggaacggaccgaccggtacccggtaccgttacgtttacctcgggttacgaaccgaaaacggtacccttacgtttaacgtttttcgggggccccgtaccgggtccccggtaacgttaacccgggtcgggggtaccccgaaaccggggg

SEQ ID NO: 357433 - DNA, 523 bp, Homo sapiens
  misc_feature: GZ8MTXP02FOGJ2.22.36.D03.1.454.CMB.2.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
  modified_base (250)..(250): a, c, t, g, unknown or other
  misc_feature (250)..(250): n is a, c, g, or t
  modified_base (413)..(413): a, c, t, g, unknown or other
  misc_feature (413)..(413): n is a, c, g, or t
  modified_base (521)..(521): a, c, t, g, unknown or other
  misc_feature (521)..(521): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccgagggaaggggttgcagtgggtctcggggattggaagtgatggtgccanacactacgcagactccgtgagggccncttcatcatctccagagacgattccgaaaacncagtgaatctgcaaatgtacagcctcagcgccgaggacacggccgtctacttctgtgcgaaagacctctatttttcgggcgcggccgacctacgtggggccagggcaccctggtccaccgtctcttcagcctccaccaacgggcccactcgtctcccctgccnccctgctccacgacgcacctccgagacgcacagccgcccgtgggctcgcctggtcgaacggactacgttccacgcgtatcgtctggagcggtcgcggcaaggcgcganag

SEQ ID NO: 357434 - DNA, 738 bp, Homo sapiens
  misc_feature: GZ8MTXP02JVG0W.22.36.D03.1.454.CMB.2.raw
  modified_base (279)..(279): a, c, t, g, unknown or other
  misc_feature (279)..(279): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggcttggtacgagggccggggggtccctgaccactctcctgtgcagcctcgtggattcacngtcagcagcaatcgccagtgagttcgggtccgccgaggcctaccggaggggtaaggggttgcgtagggttggggtctcgggggtatttaggggaaagttggaacgttgggtcgacccaacgaccgaccgtaacggccaacggtacccgttccgggtggaccgggggtccctctttaccgacttacctaacttcccgtaacccgaaggaacgaaccggtaaccttaaacccggaaaaacacgtagttacgaaacttccgaaataactaaacgtacgtaaccgaccgaccgtaccgacggaccggaccggaaccggaaccggtacccggtacccgttaccgttaccgttacgtacggtacggtaaccggtaaaccgttaccgttaaccgtttacggtttaaccgggtacccggtacccggtacccggtaccggtaccggtaccggggtacccggtaccggg

SEQ ID NO: 357435 - DNA, 750 bp, Homo sapiens
  misc_feature: GZ8MTXP02FMOSB.22.36.D03.1.454.CMB.2.raw
  modified_base (175)..(175): a, c, t, g, unknown or other
  misc_feature (175)..(175): n is a, c, g, or t
  modified_base (223)..(223): a, c, t, g, unknown or other
  misc_feature (223)..(223): n is a, c, g, or t
tcagacatacgcgtcacgaccggtgctcgatttagctgcgtcacgatctctcttgggggtggggtctcaggaggcagcgctctcggggacgtctccaccatggcctgggctctgctattcctcaccttcctcactcagggcacgagggtcctgggcccagtctgccctgaacccngcctgcctcgtgtctggatcatctggacagtcgatcagctatttccgngcacgtgggaccaacgagtgactagttggttctttgtactctgttcctactcggtaacccaaacaaaccacccccgtacggaaccccaaaccccccctaactccaacttacctaattttaagtcggttacgtaccgtacccgttcccggtccggtaccctaccgtaggtacctcctacccctcgtacttcgtccgttctaccgacggtccctaccgtaacggttccgtacggccctaaacccgacccgggtacccctaccccttaaacctaccttccgtacggttcggtcccgtaccgttaggttaggaacgtacgtacgttacttacttactaacgtcgtaccttaagtttaccttaagtacggtcctaccttacgttcggttaccgttggggttacccgggtacgggtacggtaccgaccgtaacgggtcccgttaacccggttccgggtaccgtacccgaccggtaacccgtacgggtacccgtcccggttcccccggtacgtacccgttacccgtttccccgg

SEQ ID NO: 357436 - DNA, 675 bp, Homo sapiens
  misc_feature: GZ8MTXP02I1A3Z.22.36.D03.1.454.CMB.2.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (393)..(393): a, c, t, g, unknown or other
  misc_feature (393)..(393): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctgccctgacccagcctgcctcgtgtctggatcatctggacagtcatcagctatttccngcacgtcggaccaanagtgactagttggtctttgacttcgtgtcctccgtacgtaaccaacaaccgaccccacggtaccccaaaacccccctataccatcctaatttaggtcggttacgtcctaacgttccgtaccggtccctagacggtactcctcctacacgtccgtcttacncgaacggtcctaccgtaagtccgtcggaaccctaaacgcccggtacccctaccccgtaaactacgttcccgtacgtccggaccttacgtaggtttacgaacggtacgttacgtaccttaacgtttaacgttcgacgttacgttacttttaacttaaacgtccggtacctacctacgttcgttcggtttacgggttcggacgtacggccaacggtacgtaccgtaccgtccgtacgtccgaacgccgtaacggtcctcccgtacccgtcgaccttcgttcccc

SEQ ID NO: 357437 - DNA, 849 bp, Homo sapiens
  misc_feature: GZ8MTXP02FT7U5.22.36.D03.1.454.CMB.2.raw
  modified_base (272)..(272): a, c, t, g, unknown or other
  misc_feature (272)..(272): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtatggagtcgtgggggagcgttggtacgaggccgggggggtccctggacactctcctgtgcacgcctntggattcacagtcagcagcaatgcctatggtagttcggggtccgtccgaacggtccgtacccggtaagggggtaaacggggtttcggaccggttaaggggttcgggggttaccggtttaccgggggggtaacttttacgggggtaaaggttacgggtaaggtttcgggggtaccggttaccccgtaccgaaacccgtaaccggttaaacccggggacccgaaacggggtaacccgtttccccgggggtacggggtaaaccggggggtacccctccggtttacaacgttaccgtaacgttacccgtacccgaggttaaacggaccgttaaaacgttacccgaaaaaaacggtcctaaacggttagtaaacgttccgttaaacgggaacctaaaacgttacggtaaaccgtacggtaccctacgaaccgggtaccggtaccccgggaaacggtaacccgaacccggggtacccttaccgtaacccgtttaccgtaaacggtcggtaaaaccgtaaaacgtacccgttaacgttttaccggtttccggggtacccgtaccgggtaccccggttaacccgg

SEQ ID NO: 357438 - DNA, 682 bp, Homo sapiens
  misc_feature: GZ8MTXP02GDSLG.22.36.D03.1.454.CMB.2.raw
  modified_base (192)..(192): a, c, t, g, unknown or other
  misc_feature (192)..(192): n is a, c, g, or t
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (343)..(343): a, c, t, g, unknown or other
  misc_feature (343)..(343): n is a, c, g, or t
  modified_base (384)..(384): a, c, t, g, unknown or other
  misc_feature (384)..(384): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgnggtgaaggtattggagtcgtgggggaggtcttggtacgacgggccggggggtcctgacactctccgtgtgcagcctcgtggacttcacagtcagcagcaagtcncagtcgaggttcggtccnccgaggccgtaccggaaggggtagggttncgtagggtcgggtcgtcggggattaggagtcgagtggtacncacacaccgtacgcaacgtcgtccggtagaccggggtctacgttcacgtcctaacgtcctaccgacggaacgtaacgtaaccgttaaacccgaaaaacgtaccgaagttaagaaacctccgttaagaaactaaagtacgtaaccgacgtcccgagacgaccggtaacgacggaccgtaccgccgttacgttccgttacgtacggacgtaaccgtaaacgttcccgttacgtttaacgggtttcccggaccgtcccgggtacctaaccggtccggtacgggggaccccgtaacccgggg

SEQ ID NO: 357439 - DNA, 662 bp, Homo sapiens
  misc_feature: GZ8MTXP02GC7JJ.22.36.D03.1.454.CMB.2.raw
  modified_base (469)..(469): a, c, t, g, unknown or other
  misc_feature (469)..(469): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggagcttggacgaggccggggggtccctggacactctcctgtgcagcctcgtggacttcacagtcagcagacaatcgaccatggaggttcgggtcccgccgaggcctacggacggggtaagggttcgcgtagggtcggtcggtcggggtagttggaagtgacgtcggtcgaccacacaccgtacgcgtacgaccgtcggtcgacgggggtcctcgttcctatcactcgcgtagacgtaacgacttaccgaaaacncgtagtacgatactagacgtaaatgtaaccacgtaccgtacgacgccggaccggaacggaccgtaccgtcccgtaccgttaccgttacgtcggtacgtaaaccggtaaacgtacccgttacgtttaacggttttccggggaccccggtcgggtacccggtaaccgtcgggtacccggggaccgtaacccgggg

SEQ ID NO: 357440 - DNA, 711 bp, Homo sapiens
  misc_feature: GZ8MTXP02JAY5N.22.36.D03.1.454.CMB.2.raw
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (328)..(328): a, c, t, g, unknown or other
  misc_feature (328)..(328): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtcggaaccaangtgactagttggtctttgactctgtctctagtaccaacaccaccacgaccccaaaccccccatcatctattatgtctcactccgtcgcctacgnggtactctctccactccgtctttctcgacggtcctaccgtaacgttccgtacggacccaaaccgacccggtacccccttacccctaaaacctgttcccgttcgtaccggggttcccttaccgttaagggtttaccgaacggtacgttaacgttactttaacgtttaacgttaccgtagttaacccgttagttttaaccctttaaagtaccggtcccgtaccttacgttcgttacggttttacgggttcgggacgtacggtaccgtaaccgtacggttacccgtacccggttaccgtcgggtaacccgtacccgaacccggtaacggtcccgtaccccgggtcccccgttacggtacccgttacctttcccgtttaccccccgg

SEQ ID NO: 357441 - DNA, 660 bp, Homo sapiens
  misc_feature: GZ8MTXP02I0VXE.22.36.D03.1.454.CMB.2.raw
  modified_base (234)..(234): a, c, t, g, unknown or other
  misc_feature (234)..(234): n is a, c, g, or t
  modified_base (256)..(256): a, c, t, g, unknown or other
  misc_feature (256)..(256): n is a, c, g, or t
  modified_base (310)..(310): a, c, t, g, unknown or other
  misc_feature (310)..(310): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaangtgactagttggtctttgactntgtctctgtaccaacaccaccacgacccaaacccccatcatctattacgtggtntcgactcgtccgccctagaggtacgtcctctccacttccgtacctttcgtaccgacggtcctaaccgtaaggttccgtaccgggtaaccaaaacccggtcccggttaccccctaacccctaaaccgtccttcccgtcgtccgggtccttacgtacgtttacggacggtacgtacgttaccttacgttaacttcacggttcttaacgtttacgtttaaaacgtccgtaccgtctacgttcgttcggttcgggttccgggacgtacgtaccgtaccggtacgtaccgtacccgttcgaccggtacgaccgaacccgtacgccgtcccgccccttacggtacctcggttaccc

SEQ ID NO: 357442 - DNA, 627 bp, Homo sapiens
  misc_feature: GZ8MTXP02IM4F5.22.36.D03.1.454.CMB.2.raw
  modified_base (405)..(405): a, c, t, g, unknown or other
  misc_feature (405)..(405): n is a, c, g, or t
tcagacatacgcgtcacgaccggtgctcgatttagctgcgtcacgatctctcttgggggagagaggagcccagccctgggatttttcaggtgttttcatttggtgatcaggactgaacagagagaactcaccatggagtttgggctgaagtggcttttgcttgtggctatttttaaaaaggtgtcaagtgtgcggtgaggtattggagtctgggggaggcttgggtacagccgggggggtccctgacactctcctgtgcagcctctggattcacagtcagcagcaatgaccatcgagttgggtccgccaggctccgagggaaggggtttgcagtgggtctcggggattggaagtgactggtgcacacactacgcagctccgtgacggggcgcttcatcatctcanagacacttacgaaacacacgtgaaatcgtagacaaagtgttacgaacgacccgtacaacggccgacccgggacggaaccgtaaccggggaccccggttaccttacccgtttaacgttcggttacggacggaaaaccgggtacccttacgtttaacggttttttaacgggaccccggtcggtccccggtaaccgtaccgtttcgggggaccccgtaacggggg

SEQ ID NO: 357443 - DNA, 632 bp, Homo sapiens
  misc_feature: GZ8MTXP02IK639.22.36.D03.1.454.CMB.2.raw
  modified_base (219)..(219): a, c, t, g, unknown or other
  misc_feature (219)..(219): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaaccaacagtgactagttgggttctttgactctgtcctccgtagtaaccaacaaccaccacgaccccaaacccccatctactactatttatggtctactacgtccgtccgccctgaggtactctaccctctatccgtcttacctacgacggtcctaccgtaaacgtccgtacggacccaacgcccggtacccctaccctaacgtacctcgtcgtacggcctacgtagttgaacggtactacgtacttaacgttactactggtactacgtttacttaaagtcgactcttactcgttgttacggttcgacggtcgaccgtacggtaacgtacgaccgtccgtacggtaccgtaaccgaaccgtacggtcccttacccggtaccccgttcgtacctaccgtttcccg

SEQ ID NO: 357444 - DNA, 638 bp, Homo sapiens
  misc_feature: GZ8MTXP02GE836.22.36.D03.1.454.CMB.2.raw
  modified_base (274)..(274): a, c, t, g, unknown or other
  misc_feature (274)..(274): n is a, c, g, or t
  modified_base (307)..(307): a, c, t, g, unknown or other
  misc_feature (307)..(307): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (389)..(389): a, c, t, g, unknown or other
  misc_feature (389)..(389): n is a, c, g, or t
  modified_base (398)..(398): a, c, t, g, unknown or other
  misc_feature (398)..(398): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggcccggggggtccctgacactctcctgtgcagcctctggattcanagtcagccagcaatgccagtgagttgggtcccnccaggcctacgaggggaagggttgcgaggtgggtctcggggattgggaagtcgatggtnccganacacctgcagactccggngacggggcngttcagtacatctaccgaagagacgaacttaaccgaaaacacacgtagaaactccgtagacctaaaagtcgtaacacgtacccacgaacggccgacggacggaaccgaacccggggttcccgttaccttaaccgtttcgtacgtaccggtaaaccgtaaaaccgttacccttacgtttaaacggttttccgggacccgtccgggtacccgtacgtaacggtccggggaccgtacccgggg

SEQ ID NO: 357445 - DNA, 714 bp, Homo sapiens
  misc_feature: GZ8MTXP02IJFEZ.22.36.D03.1.454.CMB.2.raw
  modified_base (265)..(265): a, c, t, g, unknown or other
  misc_feature (265)..(265): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaggtgtcaagtgtgcggtgaaggtattggagtcgtgggggagtcgttggtacgaggccggggggtcctgacactctcctgtgcngcctctggattcacagtcagcagcaatcgccagtggtagttcggtcccgcgaggcctcggaggggtacggggttgcgtagggtgggtcggtcggggtattagggaagtgagtggtcgacccacgacactaaccggcacggtaccgtccgggtcgggacgggggtccctacgtttacgacgttcctacgttccgtacccgtaaggaaccgtaaaccggtaaacgttaacccggaaaaaacccgtacgtaaaggttaacgtaaactcccgttaagaaacccgttaaaagtcggttaaaccacggtaccccgttacgaacgggcccggaacccggaacgggtacccgacccgggtacccgttacttaaccgtttccgtagtccgtaaacggtaaaccgttaccgttacgttttacgggtttccgggacccggtccggaacccgttacccggg

SEQ ID NO: 357446 - DNA, 741 bp, Homo sapiens
  misc_feature: GZ8MTXP02FIDUK.22.36.D03.1.454.CMB.2.raw
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
tcagacatacgcgtcacgaccggtgctcgatttagctgcgtcacgatctctcttgggggagctctgagagaggagcccagccctgggattttcaggtgttttcatttggtgatcaggactgaacagagagaactcaccatggagtttgggctgaagtggcttttgcttgtggcttaatttttaaaaggtgtcaagtgtgcggtgaaggtatggagtcgtgggggaggcttgggtacagggcccggggggtcctgacnctctctgtgcngcctntggattcacngtcagcagcaagtcgacctaatgggtaggtttcggggtcccgaccgacggtccctaccgggaagggggtaaagggggtttgccgtagggtggggttcggtcggggtagtttagggaaggtgagtgggtcaccacacacgtacgacgacgacgtccggtagggacgggggcccgtccgttcaacgtccactcgtaccgaacgaacgacgtaaccttaacccgaaaaacgaccgaaggttacgtaaattacgttacgaactaaaacgtacgtaacctacggtaccctaccggacggacccggaacccgggaacgggtacccgaacccggggtaccccgttaccggtttaaccctttcggttaccggtaacggtaaacccggtaaaacggtacccgtttaccgtttaacggggtttttccgggggaaccccggtcccggggtaccccggttaaccccgggg

SEQ ID NO: 357447 - DNA, 665 bp, Homo sapiens
  misc_feature: GZ8MTXP02JH4MV.22.36.D03.1.454.CMB.2.raw
  modified_base (174)..(174): a, c, t, g, unknown or other
  misc_feature (174)..(174): n is a, c, g, or t
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (360)..(360): a, c, t, g, unknown or other
  misc_feature (360)..(360): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacgagggtcctgggcccagtctcgccctgacccngcctgcctccgtgtctggactcatcgtggacagtcgatcagtctattccngcagtcggaccangtcgactagttcggttcttgactctcgtcctcgacgtaccaaccaccacccgacgaccccaaacccccatctatactattgtcggtctctaccgtcgtccgtccctgacgtcttctacccgtnacgttctccttcgacgtcgtccctacgacgttccgacggtaccaaccgtacccgtccctaacccgtacctacgttccgtacgtcggtacccttacggtaggttcggaacgtacgttcttacttacttcgtacgtcgttacgtttactttaccgttaaagtccgaccgttaccttaggttcccgttaggggtttcggtacgggcggtaaccgtacggtaaaccggtcgtacccgggtaccgttcggtccgtaccggcggttaacccgcgttccgtccccgtacccgtcgtacctacccgtttcccg

SEQ ID NO: 357448 - DNA, 716 bp, Homo sapiens
  misc_feature: GZ8MTXP02IT395.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggcttattttaaaaggtgtcaagtgtgcggtgaaggtattggagtcgtgggggagcgttgggtacgacgggcccggggggtccctgaccactctcctgtcgcacgtcctcgtggtacttccacgagtcagcagccaatcgcctagtggtaggtttcgggacccgccgtacgggccgtaccggaagggggtaaggggtttcgacggttaggggttcggggttccggtcgggggtagtttaggggaaaggtggtacgttgggtaccacccgaacaccaaccgtaccgcgtaacggtacccgtccgggtacggggaccgggggtccctctttacactcgtacctcccgtaccgagaacgtaacgtaaccgttaaacccgaaaacgtacgagtacgtaaactcgtacggaactaagtacgtacgaccgaccacgacggcgaccgacgaccgaccgtccgtacttacgttcgtacgtacgaacgtaaaccgttaccttacgtttacggtttccgggcccgtaccgggaccgtacggttaccggcgggtaccgaccgg

SEQ ID NO: 357449 - DNA, 681 bp, Homo sapiens
  misc_feature: GZ8MTXP02H4SLQ.22.36.D03.1.454.CMB.2.raw
  modified_base (201)..(201): a, c, t, g, unknown or other
  misc_feature (201)..(201): n is a, c, g, or t
  modified_base (272)..(272): a, c, t, g, unknown or other
  misc_feature (272)..(272): n is a, c, g, or t
  modified_base (439)..(439): a, c, t, g, unknown or other
  misc_feature (439)..(439): n is a, c, g, or t
tcagacatacgcgtcacgaccggtgctcgatttagctgcgtcacgatctctcttgggggagagaggagcccagcccctgggattttcaggtgttttcatttggtgatcaggactgaacagagagaactcaccatggagtttgggctgaagtggcttttgcttgtggctattttaaaaggtgtcaagtgtgcggtgaaggtnttggagtcgtgggggaggcttgggtacgagggtcccggggggtccctggacactcctcctgtcgcagcctntggattcactagtcagcagtcaatcgaccagtcgaggtttcgggccgccgaggccctaccggaggggaggggtttgaccgtagggtcggtcggtcggggtatttaggggaagtcgacgttggcgccaacgtacaccgtacgctagaccgtcggtggacgggggtccngtttcaactcgactccaccgagaacgacgtaaccgttaacccgaaaacacgagtacgaaattaccgtagaacctaaagtacgttaaccgagaccctacggaaccggcccgaccgggacggaccgtaccgcccggttactaccgttcgtcgttacggaacgtaaaccgaccgtttacgttacggttttccgggaccggttaccggacccggtacgtaccgggttaccggggacgtacccgggg

SEQ ID NO: 357450 - DNA, 605 bp, Homo sapiens
  misc_feature: GZ8MTXP02JX6M7.22.36.D03.1.454.CMB.2.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgtcctgacccagcctgcctccgtgtctggatcatctggacagtcgatcagcatttccngcactggaccaacngtgacattggtctttgactctgtctctgtaccaacacaccagaccaaacccccatcatcattanggtncactcgtcgcctcagactctcctcatcgcttctcaggctccaagtccgtggaccaacgaccggtccctaccctaaacctactcctacgtcgggcctaccgtaggtttcggacggtacgtacgttacttaactttacttaacgtgtaccttacggtttaccctttaaaagttcgggacctacctaccgttcgttcggtttcgggtttacggcggtacgccgtaccggaacggtcgtacccgtccgtcggtaccacggaacccgtaacggcccgttccgcccccgttacggtaccctacgttcccgg

SEQ ID NO: 357451 - DNA, 552 bp, Homo sapiens
  misc_feature: GZ8MTXP02F3DJI.22.36.D03.1.454.CMB.2.raw
  modified_base (366)..(366): a, c, t, g, unknown or other
  misc_feature (366)..(366): n is a, c, g, or t
  modified_base (381)..(381): a, c, t, g, unknown or other
  misc_feature (381)..(381): n is a, c, g, or t
  modified_base (424)..(424): a, c, t, g, unknown or other
  misc_feature (424)..(424): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggcccgggggggtccctgacactctcctgtgcagcctctggattcacagtcagcagcaatgccatgagttggccgcaggctccaaggggaaggggttgcagtggggtctcggggattgggaaagtgatggtcgccaanacacagcagactcgngacggggctctcatcatcacagagacactacaaaacaacaganaatactagacaaatagtaacacgaccacacgcgacgacgacgacgccgtctacttctcgtagacgaaacgtacctacccccccttacgtttcggtccggcggtaccgacgtacgtacgggacggacgg

SEQ ID NO: 357452 - DNA, 661 bp, Homo sapiens
  misc_feature: GZ8MTXP02IO1MH.22.36.D03.1.454.CMB.2.raw
  modified_base (521)..(521): a, c, t, g, unknown or other
  misc_feature (521)..(521): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgtcttgtggtcttattttaaaaggtgtcaagtgtgcggtgaaggtattggaggtcgtgggggaggcgttgggtacgaggccggggggtcccctggacacttctccgtgtcgcagcctctggtattcacagtcagcagcaatgaccagtgacggttcgggtccgccgacggcgtaccgaggggaaggggttgcgtagggtggggttacgtcgggggtattgggaagtggagtggtcgcctacaccacgtacgcgacgaccgtccgggtggacgggggcctcttacgacttcaccgttctccgagtaacgaacgtacgttaaccgaaaacctagagtacgaaatcgtgaactaatacgtacaacnccgtacgagcgacccgaggaccctacggccgttaccgtaccgttgttacggacgaacgtaaaccgtcctttacggtttaacggttttccgggcccgtccgggtacccgtaacgtccggtaccgggggacttaacccgggg

SEQ ID NO: 357453 - DNA, 641 bp, Homo sapiens
  misc_feature: GZ8MTXP02I5R0T.22.36.D03.1.454.CMB.2.raw
  modified_base (184)..(184): a, c, t, g, unknown or other
  misc_feature (184)..(184): n is a, c, g, or t
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (257)..(257): a, c, t, g, unknown or other
  misc_feature (257)..(257): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtntctggatcatctggacagtcgatcagctatttccngcacgtcggaaccaanagtcactgttggtctttgactntgtctctgtaccaacacaccacgacccaaacccccactacatactatttatcggtagtaacctcgaccgtccctcgacgtacgtctctccatccgtcttcgtcacggtctccgactcgtacggaccaacgacccggaccttaccccgtaaacctactcccgtcgtacgggtacctcccgtagtttcggaggtacgtaagttacttaactttaatacttcggacttacgtttaccgtttaaagtcgaccgtcctacttccgtacgtttcggtttacggcggacgtaccgacggtaatccggtaccgttccgtacggtaccgtaaccgtaccgaacggtcccgtacgtacccccgtacgttaccgtacccgttacgtttcccccgg

SEQ ID NO: 357454 - DNA, 680 bp, Homo sapiens
  misc_feature: GZ8MTXP02GYTDE.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttggtacgaggccggggggtccctggacactctcctgtgcagcctcgtggattcacagtcagcagcaatgccagtgagttcgggtcccgccaggcctccgaaggggtaaggggtttgcgaggtggggtcgtcggggattggggaagtgaacgtggtcgccgacacgactacgcctagacccgttccggaggaccgggggtcctcgttacgaatcactcctaccgagacgtaacgacttaaccgaaaacacgagtagaaactcgtacgactaaactcggtaaccacgtacccgaccgacggacccggtaccgaacggaacccgaccgggtcccgttccttaaccgttcgttcggttacggaaccgtaaaacgtaaccctttcgtttaacggtttttccggggaacccggtccgggtacccggtaaccggtttacccggtacgggggacccgtaacccgggg

SEQ ID NO: 357455 - DNA, 727 bp, Homo sapiens
  misc_feature: GZ8MTXP02FG66S.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggtcttaattttaaaaggtgtacaagtgtgcggtgtaaggtattggagtcgtgggggaggtcttggtacgaggcccggggggtcctgacactctcctgtgcagtcctcgtggacttcacagtcagcagcaatgacctagtgtaggtttcggggtcccgaccgacggtccgtaccggaagggggtaaaggggtttcgacgaacgggttcggggtcggttaccggggggtaatttaggggaaaacgttgggaacggttggggtaccggacccaacgtaacccgaaaccttaccgggacaacgggtaacctccggggtacgggacgggggcccgtacttacaatcctaactcgtaccgaagacgtaacgaccttaacccgaaaaactcgaagtagaaacgttaccaggaactaaaagtacgtaacagccctacgacggaccgacggaaccggaccgaccgggtcccttaccgtactttacgtcgagtaaccgaaacgtacttccgtttacggtttccgggccgtacccgggtaccgtaacgtaccggtccggggaccgtacccggg

SEQ ID NO: 357456 - DNA, 604 bp, Homo sapiens
  misc_feature: GZ8MTXP02FVF1V.22.36.D03.1.454.CMB.2.raw
  modified_base (402)..(402): a, c, t, g, unknown or other
  misc_feature (402)..(402): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggcttggtacaggccggggggtcctgacactctcctgtgcagcctctggattcacagtcagcagcaatgaccatgagttgggtccgccaggcctccgaggggaaggggttgcaggtgggtcgtcggggattggaaagtgagtggtcgccacacactacgcgagactccggtggacgggggtcccncttcagtcagtcctacgagacgacgacttaccgaaaacacaagtgaaatcgtagacctaaatgtaacagaccctcgacgccggaccgacggaccgacgggcccgtacttaccttcgtcgtacgaccgtaaacgtacccttcgtttaacggttttccgggccggtaccggcccgtacgtaccggtcggggaccgtaaccgggg

SEQ ID NO: 357457 - DNA, 723 bp, Homo sapiens
  misc_feature: GZ8MTXP02GGNFW.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgccctccgtgtctggatcatctggacagtcgatcagctatttcctgcacgtcgggaccaacagtgactagttgggttcttttgacttctcgtcctccgtaggtaacccaacgaaccaccccgacgaccccaaaccccccatcactctatttagtcggtcgtacctacgtccggtccgccctcgaggtactcctccgactactcgcctttctacgacggtctaccaagttcctaggaccaaacgccggtaccctaccctaaccactccgtacgtcgggtcctacccgagtttacggacggtacgtacgttctttaacttacgtttacgtacgttacttacgtttaaccgtttaaacgttaccggtacccgtacctaccgtttcgttaccggtttcggggttttccggggaccggttacgggacccgttaaacccgggtaacggttaccggtaaaccccggttcccgttaaccgggtaccggaacccggttaaccccggaacggtcccgtaccccggtacccccggttacggttccctaccgtttccccg

SEQ ID NO: 357458 - DNA, 591 bp, Homo sapiens
  misc_feature: GZ8MTXP02IMOM3.22.36.D03.1.454.CMB.2.raw
  modified_base (223)..(223): a, c, t, g, unknown or other
  misc_feature (223)..(223): n is a, c, g, or t
  modified_base (240)..(240): a, c, t, g, unknown or other
  misc_feature (240)..(240): n is a, c, g, or t
  modified_base (303)..(304): a, c, t, g, unknown or other
  misc_feature (303)..(304): n is a, c, g, or t
  modified_base (363)..(363): a, c, t, g, unknown or other
  misc_feature (363)..(363): n is a, c, g, or t
  modified_base (409)..(409): a, c, t, g, unknown or other
  misc_feature (409)..(409): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctcgccctgacccagcctcgcctccgtgtctggatcatcgtggacagtcgatcagtctatttccngacacgtcggaccaacngtgactagtttggttctttgactctgtctcgtagaccaacaacaccacgaccccaaacccccnncatctattagtgtcgctccgtcgtccgccctagcggtactcctcctctactcgtcttcncgaccgctcctaacgtcgtaccgacaccgaccgtcccaacccgtanactcgtcgtcggtcttcgtagtttggacgtactagtcttaaacttgttactgtacttacgttttaaccgtaaacgtccggtctacctcgttcgttggtttcgggtacggcgtacgcgttacgaacgttccacgtccgtacgtcgacgtaaccgccgtcctccgccctagtccaccgtttccc

SEQ ID NO: 357459 - DNA, 730 bp, Homo sapiens
  misc_feature: GZ8MTXP02I43IG.22.36.D03.1.454.CMB.2.raw
  modified_base (326)..(326): a, c, t, g, unknown or other
  misc_feature (326)..(326): n is a, c, g, or t
  modified_base (418)..(418): a, c, t, g, unknown or other
  misc_feature (418)..(418): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggcttaattttaaaaggtgtcaagtgtgcggtgaaggtattggagtcgtgggggaggcttggtacgaggcccggggggtccctggaccacttctcctgttccagtcctctggattcacagtcagcagcaatcgacccagtcggagttcgggtcccnccgaggcctccggaaggggtaaggggttgccgtaggttcggggtcgtacgggggtatttacggggaagtggagttgggtcgaccccgtaacnccgtaaccgttaaccggccaaagtacccgtcccgggtggggaacgggggtcccgtaccgtttaccacgttaccgtaactacccgtaccgaacggaacgtaaacgtaaccgttaaaccgaaaaacctaaaccgtaaaggttaacggtaaacttacgtacgtaactaaaacgtacgtaaccgacgtaccctaacgaccggaccgaccggaacggaccgaacccgggtcccgtaccgtaccgttcgtacggtacgtaaccgtaaacgtcccttacgttacggttttacgggccgtccggtccgaaccgtttccgg

SEQ ID NO: 357460 - DNA, 597 bp, Homo sapiens
  misc_feature: GZ8MTXP02HDZI1.22.36.D03.1.454.CMB.2.raw
  modified_base (331)..(331): a, c, t, g, unknown or other
  misc_feature (331)..(331): n is a, c, g, or t
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
  modified_base (407)..(407): a, c, t, g, unknown or other
  misc_feature (407)..(407): n is a, c, g, or t
  modified_base (499)..(499): a, c, t, g, unknown or other
  misc_feature (499)..(499): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattgggagtcgtgggggagcttggtacgaggccggggggtccctggacactctcctgtgcagcctgtggtattcacacgtcagcagcaatcgccatgagtcggtccgcgaggtctaccgagggaacggggtncgaggtcgggtctcgggggatttcgggaagttnacgtgggtcacacncactacggcagctccgtaggcggggtacncttacgatcaatccacgacgagacaactccgaaaaccagagtgtaaactctaagactaaatcgaactagccctagacgcggcgaggaacccncgggccttacgtacttcgacgtacgaaccgtaaacgccgttagttaacgtttcggccccgttacggaccgtacgaccgttcggggaccctaaccgggg

SEQ ID NO: 357461 - DNA, 632 bp, Homo sapiens
  misc_feature: GZ8MTXP02IS9VK.22.36.D03.1.454.CMB.2.raw
  modified_base (221)..(221): a, c, t, g, unknown or other
  misc_feature (221)..(221): n is a, c, g, or t
  modified_base (317)..(317): a, c, t, g, unknown or other
  misc_feature (317)..(317): n is a, c, g, or t
  modified_base (552)..(552): a, c, t, g, unknown or other
  misc_feature (552)..(552): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatcgtggacagtcgatcagctattttccngcctacgtacgggaacccaacagtgactagtttgggttcttttgacttctgttctcctaggtaccaacaaccacccgacgaccccaaaccccccanccatctatttagtgtgtccacgtcgtccgccctgagtatcttcctcatccgtcttctcacggtcctaccaagttcgtacgacccaaaccgtcggtaccccctaacccgtaccacttccgtcgtcggtccttaccgtacggtttagaggtaacgtacgtacttaacgtttactttacggtctctacggtttaccttaaagtcgctacgtctccgttggttcgttacggcggtacgngtaccgtaggtcccgtaccggttccgtcggtctacccggaacctacggtcctccggtaccccctcggtactccgttcccg

SEQ ID NO: 357462 - DNA, 692 bp, Homo sapiens
  misc_feature: GZ8MTXP02ICN87.22.36.D03.1.454.CMB.2.raw
  modified_base (288)..(288): a, c, t, g, unknown or other
  misc_feature (288)..(288): n is a, c, g, or t
  modified_base (322)..(322): a, c, t, g, unknown or other
  misc_feature (322)..(322): n is a, c, g, or t
  modified_base (351)..(351): a, c, t, g, unknown or other
  misc_feature (351)..(351): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggacttaattttaaaaggtgtacaagtgtggcggtgaaggtattggagtcgtgggggagtcgttggtacgaggccggggggtcctgacactctcctgtgcacgcctctggacttcacngtcagcagacaatgccagtggtagttggggcccnccgaggcgtaccgagggggaaaggggttnacggaagggtcggggttcgacggggtatttagggaaggtgaagtggtcgaccacgacaacgtaccgatagaccttcggacggacggggtccgattacacttacgacttacgtaccaaggtaaacgtaacgaaccgttaaacccgaaaaaacgacctaaagtaggtaaacttacgacggttaaaccaaaagttacggtaaaaccgtaccgtacctacggaaccggaccggaacccggtaacggacccgtaccggtaccgttaccgttaccgttacgacggtaaccgaacgtaaaccgtaccgtttacgtttacggtttccgggaccgtaccggtaccgaccg

SEQ ID NO: 357463 - DNA, 645 bp, Homo sapiens
  misc_feature: GZ8MTXP02FYRNC.22.36.D03.1.454.CMB.2.raw
  modified_base (219)..(219): a, c, t, g, unknown or other
  misc_feature (219)..(219): n is a, c, g, or t
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
  modified_base (346)..(346): a, c, t, g, unknown or other
  misc_feature (346)..(346): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcattttccngcatgggaccaacagtgacagttgggtcttttgctctgtctctgtaccaacaacacccagacccaaacccccancatcattanggtntccactcgtcggccctcaggactctcctcatccgtcttcncgagctaccaagtcgtgaccaacgaccgtccctaccctaaaccactcctctcgggtctaccgagtttacggacggtacgtacgtcttaacgtttaacttactacgtacttaacttttaccgtttaaaagtaaccggtccgtacccttaacgtttccgttccgggtttagggtttccgggacgggtacgggtaccgtaacccggtaacggttacgaaccccggttccgtcccggttacgaaccgtaaccccggtaaacggtcccgacccggtccccccgtcggtacccctaccgttcccg

SEQ ID NO: 357464 - DNA, 575 bp, Homo sapiens
  misc_feature: GZ8MTXP02ILG5H.22.36.D03.1.454.CMB.2.raw
  modified_base (260)..(260): a, c, t, g, unknown or other
  misc_feature (260)..(260): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
  modified_base (376)..(376): a, c, t, g, unknown or other
  misc_feature (376)..(376): n is a, c, g, or t
tcagacatacgcgtcacgaccggtgctcgatttagctgcgtcacgatctctcttggggtggggtctcaggaggcagcgctctcgggacgtctccaccatggcctgggctctgctattccctcaccttcctcactcagggcacagggtcctgggcccagtctgccctgacccagcctgcctccgtgtctggatcatctggacagtcgatcagcatttcctgcaacgtgggaccaactagtgactagttggttctttgactntgtctctggtacccacaaccaccacgaccaacccccatcatcattangtntcactcgcgccctngatctcctcatcgtctctcgagcctcaagtctgcacacgccctccctaacgntctactcggtctccgtagtttcggacgagtagtcttacttagttactacgtcttacggtttacctttaaaacttcggtaccacccgtctccgttccggtttaggtttcggaccggtggaccgtcggaaacgttcgacccggttccgtcggtaccacggtcccgaacggtccttccgcccccgtaggtcccacgtttccc

SEQ ID NO: 357465 - DNA, 707 bp, Homo sapiens
  misc_feature: GZ8MTXP02FVT8G.22.36.D03.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctcgccctgacccagcctcgcctccgtgtctggatcatctggactagtcgatcagctatttccngaccacgtacggaaccaagngtcgacttagttcgggttctttagacttcgtcgtctccgtacgtaacccaaccaaaccaccccgaccgaaccccaaaccccccctatacctactacctatttacgcggttcgtcctaccgtcgtccgtcccctagaggtactctcctctactcgtacttcgacgacgtcctacgaacgttcgacgaccaacgacccgtccctaccctaacgtacttccgtacgtcggtacccttacggtaggtttacgaacggtaccgttaacgttacttaaacgtttatacgtacgtacgtttaacgtttaaccgtttaaagtccgacccgttacctacgtttcgttacgggtttacgggttcggacggttacggtacccgaacggtacggtacccgtccgtacccgttacggaccgtacccgaaccgtaccggccgttaccccggtcccgttcgtacccttacgtttccccgg

SEQ ID NO: 357466 - DNA, 617 bp, Homo sapiens
  misc_feature: GZ8MTXP02JHFFA.22.36.D03.1.454.CMB.2.raw
  modified_base (265)..(265): a, c, t, g, unknown or other
  misc_feature (265)..(265): n is a, c, g, or t
  modified_base (314)..(314): a, c, t, g, unknown or other
  misc_feature (314)..(314): n is a, c, g, or t
  modified_base (341)..(341): a, c, t, g, unknown or other
  misc_feature (341)..(341): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (542)..(542): a, c, t, g, unknown or other
  misc_feature (542)..(542): n is a, c, g, or t
tcagacatacgcgtcacgaccggtgctcgatttagctgcgtcacgatctctcttggggggagagaggagcccagccctgggattttcaggtgttttcatttggtgatcaggactaaacagagagaactcaccatggagtttgggctgaagtggcttttgcttgtggctatttaaaaggtgtcaagtgtgcggtgaaggtattggagtcgtgggggagtcgttggtacgaggccgggggggtccctggaccactctcctgtcgcancctcgtggattcacagtcagcagacaatcgacatggtagttcgggtccnccgaggcctaccgaggggaagggttcngaggtgggtctcggggtacttaggaagtgagtcggtnaccanacatccgcaggcctcggtgacggggtccgtcttcagtacactctaccgacgacgaacgtacttaacccgaaaacacgaagtagtaaatcgtagaactaaacgtactacgtacgaccgtacacgcgaccggacgaccgaccggtctaccgtacttacgtntacgaacgaaacgtacctacgtaacgttttcgggccggtcgaccgtacgtaacgtccgggacgtaccggtacccg

SEQ ID NO: 357467 - DNA, 687 bp, Homo sapiens
  misc_feature: GZ8MTXP02JQS81.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggcttaattttaaaaggtgtcaagtgtgcggtgaaggtattggagtcgtgggggaggcttggtacgacggccgggggggtccctgacactctcctgtgcagcctctggattcacagtcagcaagcaatgcctagtgacggtttcgggtcccgccgacggcctaccggaagggggtaaggggttgccgtagggttggggtaccgttcggggtaattgggaaaggtggacgtgggtcgaccacaacgtacacgtcacggtaccgtccggtggacggggtcccgtacttcgactcacgtcctacgagaagaacgtactaaccgaaaacacgtaacgtacgtaaacttctacgaactaaagtacgtaacgtacgaccgtacgacgccgacggaacggaccgaccggtaccgttccttaacgttcgtacggtacgtaaccgtaaaaccgtaccgttaccgtttaacggttttccgggacccggtaccggtacccgtaacgtaaccgggtccggggaccgtacccgggg

SEQ ID NO: 357468 - DNA, 637 bp, Homo sapiens
  misc_feature: GZ8MTXP02F3CDC.22.36.D03.1.454.CMB.2.raw
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (352)..(352): a, c, t, g, unknown or other
  misc_feature (352)..(352): n is a, c, g, or t
  modified_base (362)..(362): a, c, t, g, unknown or other
  misc_feature (362)..(362): n is a, c, g, or t
tcagacatacgcgtcacgaccggtgctcgatttagctgcgtcacgatctctcttggggtggggtctcaggaggcagcgctctcgggactctccaccatggcctgggctctgctattcctcaccttcctcactcagggcacgagggtcctgggcccagtctgccctgacccagcctgcctccgtgtctggatcatctggacagtcgatcagctatttccngctacgttggaaccaanggtgactagttgggttctttgacttctgtcctcgtgtaccaacaaccaccacgacccaaacccccactcatctattgtgtcgtctactcgtcggtccctcgaggtactctcctacnctcgtcttcncgacgtcctaccagtctacggccaaacgccggtccctcccgtacgtacccttcgtcgtcgggccctcgaggtccgtaggagacgtggaacggcttagtactttatacgtgacaacgttctataagtacgtggaagtacgaacggtacgtaaacgtttaggtttcggggtacggttacggggtaaaccggggtacgggaacccgtaaacgtccggtttaacccggacccggttaaccggttaacggtacccggaccgtaacccggttaacccgggg

SEQ ID NO: 357469 - DNA, 731 bp, Homo sapiens
  misc_feature: GZ8MTXP02I47GV.22.36.D03.1.454.CMB.2.raw
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
  modified_base (234)..(234): a, c, t, g, unknown or other
  misc_feature (234)..(234): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacgagggtcctgggcccagtctcgccctgacccagcctgcctccgtgtctggatcatctggacngtcatcagctatttccngcacgtggaccangtgactgttggttctttgacttcgtcgtctccgtagtaacccaacaaccacccacggacccccaaaccccccatctaactcgtactttagtcggtctaccaccgtccggtccgtaccctagacggtacgttcctccgtactacgttcccgtactttccgaccgtacggtccttacccgaaggttccgtccgacccgaaaacgtccccggtacccctaacccctaactaccgttcccgtcggttcgggtcccttacccggttaggtttacggtaacgggaccgttacgttacctttaaacggtttactttaccgtacggttactttaacccggttttaccgttttaaaacggttccggaccgttaccctacgttttccggttcggttttacggggttaccggccggtaacggacccgttaaaccggtacggtaccgtccgttaccgacgttccgaacgtaaccgacgtcctccggacccctcggtcctacgtttcccg

SEQ ID NO: 357470 - DNA, 802 bp, Homo sapiens
  misc_feature: GZ8MTXP02F88RH.22.36.D03.1.454.CMB.2.raw
  modified_base (158)..(158): a, c, t, g, unknown or other
  misc_feature (158)..(158): n is a, c, g, or t
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
tcagacatacgcgtcacgaccggtgctcgatttagctgcgtcacgatctctcttggggttttggggggggtccctgacactctcctgtgcagcctctggattcacagtcagcagcaatgccatgagttgggtccgccaggctccaggggaaggggttncaggtgggtctcggggattggaagtgatggtgccacacactacgcagactccgtgaggggccncttcatcatctccagagacgattaccgaaaacncagtagaatctagacaaatagtacacgtcctcgacggccggacccggaggaccgaccgggtcccgttccttacgtttccgtacggtcggacggtaaaacgtaccctttaccgtttagttttttaccgggggcccgtacccggggtaccgtaacccgtaccgggtccgggggacccgtacggggtccccgtaaccccggttcgggtcccctaaccccgggttcctttacccgttccgtaaccgtcccccgttacccccgaaaccccggtaaacccgggggtcccctaacccggtttcccgggttacccccgtttcccccccggttccgggaccccgtcccccgtacggcccccgttacccggaaccggtaccgtaccccgaccccgtacccggaccggaacgaccccgtacggacggtacccccgggcccgtccggggccgtccggtcccgtacgggtaccgtaaaccggaccttacccgttacccgcgtaccgttagtccgtacgtcggacggtccggggtcctcgggaccgacggcgaccgacgtag

SEQ ID NO: 357471 - DNA, 769 bp, Homo sapiens
  misc_feature: GZ8MTXP02FKJ6U.22.36.D03.1.454.CMB.2.raw
  modified_base (263)..(263): a, c, t, g, unknown or other
  misc_feature (263)..(263): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
tcagacatacgcgtcacgaccggtgctcgatttagctgcgtcacgatctctcttgggggagctctgagagaggagcccagccctgggattttcaggtgttttcatttggtgatcaggactgaacagagagaactcaccatggagtttgggctgaagtggcttttgcttgtggcttaattttaaaaggtgtacaagtgtgcggtgaaggtattggagtcgtgggggagcttggtacaggccggggggtcctgacactctcctgngcagcctctgacttcacngcagnaganaatgccatgtagttcggcnccgagctacgaggggtaagggtgacgtaggtcgggtcgtcggggtattacgggtaagtagtacggttggtacgacccgtaccaccgtaacgtacgaccgtaacgtactccgggtagggaccgggggccttaccgttacgactacgtaacctacctaccgaaacgaacggtaacgtaaaccgttaaaccggaaaaaacctaaccgtaaaggtaaacggtaaacttaccgtaaaggtaaacctaaaagttaacggtaaaccgtacggtaacccccgttaacgaaacccggacccgggtaaccccggaaacggggtaacccgtaaccccggggttacccttaacccggtttaaccgttaccggttacgttaccggaaaaccgttaaaaccgtaccccgttttacgtttaacggggtttttcccggggaacccggttacccgggaccccggtttaaacccgggg

SEQ ID NO: 357472 - DNA, 868 bp, Homo sapiens
  misc_feature: GZ8MTXP02J0FT8.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcacatggagtttgggctgaagtggtcttttgcttgtggtcttaattttaaaaggtgtacaagtgtgcggtagaaggtattggagtcgtgggggagtcgttgggtacgacgggtcccggggggtccctggacacctctcctgtgcagcctcgtgtacttcactagtcagcagacaatcgaccagtggtacggtttcgggccccgacgacggtccgtaccggaagggggtaacggggttgccgtaggggttcggggttcggtacggggtaagtttaggggaaaggttggtaagtggggtaccacccgtaaccgtaccgaaccgttacgccgaacgtacccgttaccggggtagggaccgggggtcccttacgttacctaacttcccgtaaacgttcccgtaaacgaacggtaaccgtaaacccggttaaacccgttaaaaccccggaaaaacccgtacggtaaggttaaaccggtaaaactttacccgggaaacgtaaaacctaaaaggtttccgaaaccgacccggtacccgtaacccgaacggggaccccggaaaccgggtacggaaacccccggtccggggttacccctttaccgttaacccgtttagaccgggttaaacgaaacccggttaaaacgttacccccgtttaggttttacccgggtttaacccgggggaccccgtacccgggtacccggttaacggttaccccggggtcgggggaaccccgtaacccggggg

SEQ ID NO: 357473 - DNA, 720 bp, Homo sapiens
  misc_feature: GZ8MTXP02HRIVH.22.36.D03.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (327)..(327): a, c, t, g, unknown or other
  misc_feature (327)..(327): n is a, c, g, or t
  modified_base (371)..(371): a, c, t, g, unknown or other
  misc_feature (371)..(371): n is a, c, g, or t
  modified_base (383)..(383): a, c, t, g, unknown or other
  misc_feature (383)..(383): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcacctttcctcactcagggcacgagggtcctgggcccagtctcgccctgacccagcctgcctcgtgtctggatcatctggacagtcgatcagctatttccngcacgtcggaaccaagngtgactagttgggttactttgacttctagtcctccgtacgtaaccaacaccaccgtacgaaccccaaacccccatcactctatttacgnggtcgtactcgttccggtcgtccctagacggtactcctcctacncgttctacttcnccgagtcctacgtaagtccgtacggaccaaccgacccgtccctaccctaaactcctcgtcggtcggtaccttaccggttagttacggaacgtacgttacttacgttacttacgtttctaacgttacgtttaactttaaccggtttaaacgtccggtacccttaaccgttaccgtttcggttttccgggttacggggtttcccgggaacgggttacgtacccggtaacgggtaaccgttacccggtccccgtttcggaaccggttaccaaccgggttaaccgtaaccgggggtcccttccccggtccccgttaacggtaccccgttccctttccccgg

SEQ ID NO: 357474 - DNA, 616 bp, Homo sapiens
  misc_feature: GZ8MTXP02GY6KO.22.36.D03.1.454.CMB.2.raw
  modified_base (196)..(196): a, c, t, g, unknown or other
  misc_feature (196)..(196): n is a, c, g, or t
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatcnggacagtcgatcagcatttccngcactgggaccaanagtgactattggtctttgactctgtctctgtaccaacaacacccacgaccaaaccccccatcatctattatcgtgtcactcgtccggaccctcgacggtactcttcctcactcgtccttctacgacggtcctaccaaaggtcctagaccaaacgtaccggtccctacccctaaacactcctacgtcgggtcctaccgtagtttacggaacggtacgtacgtcttaaccttagttacttgctacgttacctttaaagtacgtccgtacctacgtcgttacggttggtttcggacggtacggacctaaccgtacgtacggaccgtccgtccggtaccaccgcccgaacggtccgtaccggcccccgtccggtcctaccgtttcccg

SEQ ID NO: 357475 - DNA, 709 bp, Homo sapiens
  misc_feature: GZ8MTXP02FO5AE.22.36.D03.1.454.CMB.2.raw
  modified_base (307)..(307): a, c, t, g, unknown or other
  misc_feature (307)..(307): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggtctattttaaaaggtgtacaagtgtgcggtgaaggtattggagtcgtgggggaggcttggtacgaggccgggggggtcctgacactctcctgtgcagcctcgtggattcacagtcagcagcaatgaccatgagttcgggccnccgaggctccgaggggtagggttgcgtaggtggtcgtcggggattgggaaagttgagttcgggtcgaccaacgacaaccgttacgcgtaacggaccgtaccggtgggaacgggggtccctcgtttacacgttccaacgtcctaccgaaggtaccgaacggtacctttaaacccggaaaaacacgtaaacgggtagtaaacttccgttaaggaactaaaagttcggtaaaccaacgggtaccctacgaccggccgacccgggacggtaaacccgaccggtccccgttaacgttaacccgttcgttacggtaccggaaacggtaaaaccgtacccttagtttaacgttttccgggggacccgtaccggtacccgtaccgtacggtcgggggcccgtaaacgggg

SEQ ID NO: 357476 - DNA, 725 bp, Homo sapiens
  misc_feature: GZ8MTXP02F7LI4.22.36.D03.1.454.CMB.2.raw
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccagcctcgcctccgtgtctggatcatctggacaggtcgatcagctatttcctgcacgtcgggaaccaacagtgtacagttgggtcttttgacttctcgtctcctcggtaaccacaaccaccacgaccccaaaccccccactcaatctatttagtcgtgtacctacctcggtccggtccctcacgggtcttaccctccctctaccgtccgttcctttagtccgacgggtctttacccgaaaggttccgtaccgaccaaccgtacccggccccttacccccgtaaaccctacttcgtaccgttcggcccgtttaccgtaagggtttcggtaaggacgtacgttacttacgtttacgtttactcgtacttacgtttaccgtttaaaagtcccggtacgtacccgtaccgttcgtttccggtttggggtttacggggcgggtacggccggtaaaccggtaacggttcggtacccgtttccgtacgggttccccaacgggtaacccggtaaccggtccgtaccccgtcccccggttcgttaccccctactttcccccggg

SEQ ID NO: 357477 - DNA, 647 bp, Homo sapiens
  misc_feature: GZ8MTXP02I40I0.22.36.D03.1.454.CMB.2.raw
  modified_base (321)..(321): a, c, t, g, unknown or other
  misc_feature (321)..(321): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtcctgacactctcctgtgcagcctctggattcacagtcagcagcaatgccatgagttggccgcaggcctccgaggggaagggttncgtagggtcggtcgtcggggattgggaagtggagtggtcgcccacgactacctacgcgacgacgtccggtggacgggggtcccgtctttcgaacgtcctaactcgttccgacgacgaaccgtacgttaacccggaaaaccacgtaacgtagtaaacgttctagaacctaaagtagtaacacgaccgtacgacgccggaccgacggaccgacggtacccgtacgttacgttacgtcggtacgtaaccgtaaacgtaccgttcgtttacggttttaacgggcccggtacggtcccgacgtttaccggaccggggtaccgtacccgggg

SEQ ID NO: 357478 - DNA, 534 bp, Homo sapiens
  misc_feature: GZ8MTXP01BUK53.13.12.B01.1.454.CMB.2.raw
  modified_base (236)..(236): a, c, t, g, unknown or other
  misc_feature (236)..(236): n is a, c, g, or t
  modified_base (362)..(362): a, c, t, g, unknown or other
  misc_feature (362)..(362): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (520)..(520): a, c, t, g, unknown or other
  misc_feature (520)..(520): n is a, c, g, or t
  modified_base (533)..(533): a, c, t, g, unknown or other
  misc_feature (533)..(533): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaaggccattcgcatctcaganacaattccaggaacacgctgtacctggagatggacggcctgagacctgacgacacggcaatttatactgtgcgaggtttatgtgttggaacgtggtacaccggaaaatggttcgaccctggggccngggaaccctgggtcgtcgtctcgtctgcctcaccaagggccatcgtctcccctgcnccngctcagngcacctccgagcgcacgagccgccgtcgggctcgccgtcggtcaacgggtacttacgttccgtagttacgttcgacgtaagcggcggtcggnggacgaacggcgng

SEQ ID NO: 357479 - DNA, 529 bp, Homo sapiens
  misc_feature: GZ8MTXP01AWLHJ.13.12.B01.1.454.CMB.2.raw
  modified_base (366)..(366): a, c, t, g, unknown or other
  misc_feature (366)..(366): n is a, c, g, or t
  modified_base (439)..(439): a, c, t, g, unknown or other
  misc_feature (439)..(439): n is a, c, g, or t
  modified_base (456)..(456): a, c, t, g, unknown or other
  misc_feature (456)..(456): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttatactgtgcgtaggtttatgtgttggacgtggtaccaccggaaatggtcgacccgtggggccngggaccctgggtcgtcgtctcgtctcgcctccaccaagggcccagtcggtcctcccctggccgccctgctccnggacgcaccgtccgagncacagccgcctgggctgcctggcaggcttacgttcctagttacgttgactggagcggctgggcaaggcgaacg

SEQ ID NO: 357480 - DNA, 566 bp, Homo sapiens
  misc_feature: GZ8MTXP01DGO0E.13.12.B01.1.454.CMB.2.raw
  modified_base (267)..(267): a, c, t, g, unknown or other
  misc_feature (267)..(267): n is a, c, g, or t
  modified_base (323)..(323): a, c, t, g, unknown or other
  misc_feature (323)..(323): n is a, c, g, or t
  modified_base (364)..(364): a, c, t, g, unknown or other
  misc_feature (364)..(364): n is a, c, g, or t
  modified_base (390)..(390): a, c, t, g, unknown or other
  misc_feature (390)..(390): n is a, c, g, or t
  modified_base (565)..(565): a, c, t, g, unknown or other
  misc_feature (565)..(565): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccgagggaaggggctggagtggttggcagtcatttcagatgatggcaatgataaatattacgcacgctccgtgaagggccgattcgccatctccagagacaaattccaggaacacgctgtaccnggagatggacgcctgagacctgacgacacggcaatttatactgtgcgtaggtttangtgtggaacgtgtaccaccggaaatggtcgacccgtgggcngggaaccctgggtcgtcgtctcgtcncgcctcaccgaacgggcccagtccggtccttcccccgtggccgcccgtgcctccgacgggaccgccacccgtcgacgacgcgacgcgccggccgtcggctcgccgtggtacgaacggtaccttacgttaccgtagttacgttcgacgtggacggcgggcgtggacgtaacggcgng

SEQ ID NO: 357481 - DNA, 604 bp, Homo sapiens
  misc_feature: GZ8MTXP01EBV44.13.12.B01.1.454.CMB.2.raw
  modified_base (79)..(79): a, c, t, g, unknown or other
  misc_feature (79)..(79): n is a, c, g, or t
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
  modified_base (261)..(261): a, c, t, g, unknown or other
  misc_feature (261)..(261): n is a, c, g, or t
  modified_base (577)..(577): a, c, t, g, unknown or other
  misc_feature (577)..(577): n is a, c, g, or t
tcagtcacgtactacacgaccggtgctcgatttagtagtgtagattcgcaggcgtggtccagcctgggaggtccctganactctcctgtgcagcctctggattcaccttcagttcctttgctatgcattgggtccgccaggctccgaggggaaggggctggagtggttggcagtcatttcagatgatggcaatgataaatattacgcacgctccgtgaaggccattcgcatcncaganacaattccagaacacgctgtacnggagagtggacggcctggacgaccgtgaccgacacggactaatttatactgtgcgtaggtttatgttgtaggacgtgtaaccaccggtaaactggtaccgacccgtaggggacctcggggaccctgggtccgtcgtcgtcgtctcgccctccgaaccgacgggcccacgttcccggttccttcccccgtggcccgccctcgcctccgacggaccgtcccgacccgtccgacgacgccgaaccgccgggcccggcccgttcggggccttccggccgtcggtacgaacggtccttacgtccgtacgttacgttgacgnggtgcggtcgcggacgaacggcgaacg

SEQ ID NO: 357482 - DNA, 548 bp, Homo sapiens
  misc_feature: GZ8MTXP01C4GJT.13.12.B01.1.454.CMB.2.raw
  modified_base (357)..(357): a, c, t, g, unknown or other
  misc_feature (357)..(357): n is a, c, g, or t
  modified_base (379)..(379): a, c, t, g, unknown or other
  misc_feature (379)..(379): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggacaatttattactgtgcgtaggttatgtgtggagtgtaccacggaaatgtcgcctgggcnggacctggtcgtcgtctcgtcncgctccaccaagggcccagtcggtccttccccgtcggccgcccgtcgcctccgacggacggccaccgtccgagaacgccacgacgccggcccgtgggcctcggcctcggtacaaagggtcccttacgttcctagttacgttgactggagcgggctgggccaaggcgaac

SEQ ID NO: 357483 - DNA, 533 bp, Homo sapiens
  misc_feature: GZ8MTXP01A2YVT.13.12.B01.1.454.CMB.2.raw
  modified_base (365)..(365): a, c, t, g, unknown or other
  misc_feature (365)..(365): n is a, c, g, or t
  modified_base (521)..(521): a, c, t, g, unknown or other
  misc_feature (521)..(521): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaaggccgattcgccatctcagagacaattccaggaacacgctgtacctggagatggacggcctgagacctgacgacacggcaatttattactgtgcgaggtttatgtgttggaacgtggtaccaccggaaatggttcgaccctggggccngggaaccctggtcgtcgtctcgtctgcctcaccgaacgggcccatcggtccttccccgtgccgccctgctccaggcgcaccgtccgagagccacgagccggccctggggctcgcctggtcaaggcttcgtcctagttacgttgacgtgagcgggcnggcaacggcgcg

SEQ ID NO: 357484 - DNA, 576 bp, Homo sapiens
  misc_feature: GZ8MTXP01BXYXA.13.12.B01.1.454.CMB.2.raw
  modified_base (275)..(275): a, c, t, g, unknown or other
  misc_feature (275)..(275): n is a, c, g, or t
  modified_base (575)..(575): a, c, t, g, unknown or other
  misc_feature (575)..(575): n is a, c, g, or t
tcagtcacgtactacacgaccggtgctcgatttagtagtgtagattcgcaggcgtggtccagcctgggaggtccctgatactctcctgtgcagcctctggattcaccttcagttcctttgctatgcattgggtccgccaggctccgagggaaggggctggagtggttggcagtcatttcagatgatggcaatgataaatattacgcacgctccgtgaaggccattcgccatctccagagacaacgccaagactcactatattgacaaatggaccnctgagagacgaggacacggctatgtaattacgtgtgcgagagatggagagtcggctacgaggttcgggggcccgggaaaccctgggtcaccgtcaactcacgcctcgaccgacgggcccacgtccggtccttccccgtggcccgccctcgcctccgacggacgcaacccgtccgggacgacgccacgacggcccggcccgtgggcctcggccgtgggtaccaacgggtaaccttaccgttccgtacggttacgtcgtacgttggcggttccggggcgtgggcgaagggccgcgaagttgng

SEQ ID NO: 357485 - DNA, 528 bp, Homo sapiens
  misc_feature: GZ8MTXP01A3EMK.13.12.B01.1.454.CMB.2.raw
  modified_base (263)..(263): a, c, t, g, unknown or other
  misc_feature (263)..(263): n is a, c, g, or t
  modified_base (516)..(516): a, c, t, g, unknown or other
  misc_feature (516)..(516): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaagggctggagtggttggcagtcatttcagatgatggcaatgataaatattacgcacgctccgtgaaggccgattcgccatctccagagacaattccaggaacacgctgtaccnggagatggacggcctgagacctgacgacacggcaatttatactgtgcgaggtttatgtgttggaacgtggtaccaccggaaaatggtcgaccctggggccaagggaaccctgggtcgtcgtctcgtctcgcctcacaacgggcccatcggtccttcccctggccgccctgctccaggcgcaccgtccgagagcacgagccgccctgggctcgccgtggcaggcttacgttcctagttacgttgactgagcggntggcaacggcgc

SEQ ID NO: 357486 - DNA, 637 bp, Homo sapiens
  misc_feature: GZ8MTXP01CH9J4.13.12.B01.1.454.CMB.2.raw
  modified_base (239)..(239): a, c, t, g, unknown or other
  misc_feature (239)..(239): n is a, c, g, or t
tcagtcacgtactacacgaccggtgctcgatttagtagtgtagattcggcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcatcaccatctcctgcacgtgggaccagcagtgacgttcgnggtacaaagtactatgtcctcctaggtaacccaaacaaccacccgaaggaccaaaccggtaccccccaaaatcaaattaaatttatacgtaatttacaactaacgtccggaccctacgaggttatatactaatccgtcttcacgtccggctactaagtctaggaacccaacgcccggtccctaccctacgaacctgtccgtcgtcgggcctaccgaggacagggaacggacgacggtctaggtaacttaacgtcgtggccgtctccggggtaggtacgtacttcgaaccttaccgttatcggttcgtcggtatgtacgaactaacggtcttaccggtcttaaggccaacgacccgacggaccccaacccatctactaccgttctccgttccccgtccc

SEQ ID NO: 357487 - DNA, 559 bp, Homo sapiens
  misc_feature: GZ8MTXP01A1D53.13.12.B01.1.454.CMB.2.raw
  modified_base (263)..(263): a, c, t, g, unknown or other
  misc_feature (263)..(263): n is a, c, g, or t
  modified_base (554)..(554): a, c, t, g, unknown or other
  misc_feature (554)..(554): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaaggccattcgccatctccagagacaattccaggaacacgctgtaccnggagatggacgcctgagacctgacgacacggcaatttatactgtgcgtaggtttatggtgtggaacgtgtaccgaccggaaatggtcgacccgtggggccaagggaaccctgggtcgtcgtctcgtctcgccctcaccgaacgggcccagtccggtccttcccccgtggcccgccctgcctccgaggacggccaccgtccgagacgcacgtacgcggcccgtggggcctcgccgtgggtcaaagggtcttacgttcctagttacgttgacgtggaggcgggctggcaaggngaacg

SEQ ID NO: 357488 - DNA, 519 bp, Homo sapiens
  misc_feature: GZ8MTXP01CELSJ.13.12.B01.1.454.CMB.2.raw
  modified_base (364)..(364): a, c, t, g, unknown or other
  misc_feature (364)..(364): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (507)..(508): a, c, t, g, unknown or other
  misc_feature (507)..(508): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaaatgataaaatattacgcacgctccgtgaagggccgattcgccatctccagagacaattccaggaacacgctgtacctggagatggacggcctgagacctgacgacacggcaatttattactgtgcgagggtttatgtgttgaacgtgtacacggaaaatgtcgaccctgggccngggaaaccctggtcgtcgtctcgtctgcctcaccaagggcccatcggtctcccctggccncngcncagcgcactcgagagcacgagccgccgtggctcgcgtggtacaagtacttacgttcgtagttacgttgactgagcggnngcgaacgcgcg

SEQ ID NO: 357489 - DNA, 619 bp, Homo sapiens
  misc_feature: GZ8MTXP01EQY2F.13.12.B01.1.454.CMB.2.raw
  modified_base (296)..(296): a, c, t, g, unknown or other
  misc_feature (296)..(296): n is a, c, g, or t
  modified_base (319)..(319): a, c, t, g, unknown or other
  misc_feature (319)..(319): n is a, c, g, or t
  modified_base (573)..(573): a, c, t, g, unknown or other
  misc_feature (573)..(573): n is a, c, g, or t
tcagtcacgtactacacgaccggtgctcgatttagtagtgtagattcggcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcacgtgggaccagcagtgacgttcgtggtcaagctatgtctccgtgtacaacaacaccagcaacgccccaaatcataattatntattcactaatcggcctcaggtntatactatcgcttcactcgcctcgaagtctcggaacaaaccgcggccctacccgcgacctactctcgtgggctccgaggcaggaggtacgagctagtacttagtactggcgtctaccggtagggtaactattacggccttaaccctttgttcggttaccgttacggggtaacttcggtaacgaacccgtaagggttcccgttaccgttccgttacgggtaccaacggaccccgttaacggaccccctaaacccncggttaacgtccgtacgttccgttaaccgtttcccccgttaacccc

SEQ ID NO: 357490 - DNA, 565 bp, Homo sapiens
  misc_feature: GZ8MTXP02I5QGC.13.12.B01.1.454.CMB.2.raw
  modified_base (366)..(366): a, c, t, g, unknown or other
  misc_feature (366)..(366): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaattatactgtgcgaggtttatgtgttggaacgtggtacaccggaaactggttcgacccctggggccnggggaaccctgggtcgtcgtctcgtctgcctccaccaaggcccatccggtcttcccccgtggccgccctcgctccaggacgccacctcccggagacgccacgacgccggcccgtcgggcgtcgccgtcggtacgaaacggtacctaccgttaccgtacgtacgtgacgtaaggcggcgggtcgtcggacgacggcgacg

SEQ ID NO: 357491 - DNA, 537 bp, Homo sapiens
  misc_feature: GZ8MTXP02GO0EM.13.12.B01.1.454.CMB.2.raw
  modified_base (365)..(365): a, c, t, g, unknown or other
  misc_feature (365)..(365): n is a, c, g, or t
  modified_base (421)..(421): a, c, t, g, unknown or other
  misc_feature (421)..(421): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttatactgtgcgaggtttatgtgttggaacgtggtaccacggaaactggttcgaccctgggccngggaaccctggtcgtcgtctcgtctgcctccaccaggcccatcgtctcccctggcnccctgctccgagacgccacctccgagagccacacgccggccctggggcctcgccctcgggtccaaagggacctacgttcctacgtacgtcgactgacgcgggctggcaacggcacg

SEQ ID NO: 357492 - DNA, 526 bp, Homo sapiens
  misc_feature: GZ8MTXP02GBE85.13.12.B01.1.454.CMB.2.raw
  modified_base (443)..(443): a, c, t, g, unknown or other
  misc_feature (443)..(443): n is a, c, g, or t
  modified_base (461)..(461): a, c, t, g, unknown or other
  misc_feature (461)..(461): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatatacgcacgctccgtgaagggccgattcgccatctccagagacaattccaggaacacgctgtacctggagatggacggcctgagacctgacgacacggcaatttatactgtgcgtagggtttatgtgttggaacgtggtaaccacggaaaactggtcgacccgtggggccaggggaaccctgggtcgtcgtctcgtctgcctcaccaagggcccatcggtctccccgtgccgcctgctccagganccacctccgagacgcacncgcggccctggctgcctggtcaggctactcctagtaccgtgacctgacgcggctggccaggcacg

SEQ ID NO: 357493 - DNA, 581 bp, Homo sapiens
  misc_feature: GZ8MTXP02GPP4W.13.12.B01.1.454.CMB.2.raw
  modified_base (360)..(360): a, c, t, g, unknown or other
  misc_feature (360)..(360): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccgaggggaaggggctggagtggttggcagtcatttcagatgatggcaatgaataaatatacgcacgctccgtgaagggccgattcgccatctccagagacaattccaggaacacgctgtacctggagatggacggcctgagacctgacgacacggcaatttatactgtgcgtaggttatgtgtgaacgtgaccacgaaatggtcgacccgtgggcngggacctggtcgtcgtctcgtctcgcctccaccaacgggcccagtccggtcctcccccgtcggcccgccctcgcctccgacggacgccaccgtccgagacgccaacgcggccggcccgtgggcctcggccgttcgggtaccaaacgggtaccttaaccgttcccgtaacggttaaccggtgacccgttggacggcggggccgtggaccgaacggccgaacg

SEQ ID NO: 357494 - DNA, 553 bp, Homo sapiens
  misc_feature: GZ8MTXP02JQLIJ.13.12.B01.1.454.CMB.2.raw
  modified_base (136)..(136): a, c, t, g, unknown or other
  misc_feature (136)..(136): n is a, c, g, or t
  modified_base (321)..(321): a, c, t, g, unknown or other
  misc_feature (321)..(321): n is a, c, g, or t
  modified_base (350)..(350): a, c, t, g, unknown or other
  misc_feature (350)..(350): n is a, c, g, or t
  modified_base (359)..(359): a, c, t, g, unknown or other
  misc_feature (359)..(359): n is a, c, g, or t
  modified_base (424)..(424): a, c, t, g, unknown or other
  misc_feature (424)..(424): n is a, c, g, or t
  modified_base (449)..(449): a, c, t, g, unknown or other
  misc_feature (449)..(449): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccnccaggctccgagggaaggggctggagtggttggcagtcatttcagatgatggcaatgataaatattacgcacgctccgtgaagggccattcgccatctccagagacaatccaggaacacgctgtacctggagatggacggcctgagacctgacgacacggcaatttatactgtgcgtaggtttangtgttggacgtgtaccacgaaatggtacnccgtgggcncgggacctggtcgtcgtctcgtctcgccctccaccgaacgggcccagtcccggtccttcccccgnggccgtccctcgcctccgaggtacnccaccgtccgagacgcacgacggccggcccgtgggctcgccgtggaccgaaggtacctacgttcgtacgtacgtgaactggacgtcggctggacaagggcaacg

SEQ ID NO: 357495 - DNA, 615 bp, Homo sapiens
  misc_feature: GZ8MTXP02JA04S.13.12.B01.1.454.CMB.2.raw
  modified_base (241)..(241): a, c, t, g, unknown or other
  misc_feature (241)..(241): n is a, c, g, or t
  modified_base (361)..(361): a, c, t, g, unknown or other
  misc_feature (361)..(361): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccgaggggaaggggctgggagtggttggcagtcatttcagatgatggcaatgaataaatattacgcacgctcgtgaagggccattcgcatctccaganacaattccaggaacacgctgtacctggagatggacggcctgagacctggacgacacggcaatttatactgtgcgtaggtttatgtgtgaacgtgaccacggaaatgtcgaccgtgggccngggacctggtcgtcgtctcgtctcgcctccacgaacggcccatccggtccttcccccgtggcccgccctcgccgtccgacggacgcccacccgtccggacggacgaccgaccgacggcccgggcccgtcggggccgtcggacccggtcgggtacaaacgggtaccttaccgttacccgttaacggttaccggtcggtaacctcggggaacgggtccgggggtacgtacggggacgtaaacgggggcgtaaccgg

SEQ ID NO: 357496 - DNA, 654 bp, Homo sapiens
  misc_feature: GZ8MTXP02HDCDS.13.12.B01.1.454.CMB.2.raw
  modified_base (188)..(188): a, c, t, g, unknown or other
  misc_feature (188)..(188): n is a, c, g, or t
  modified_base (459)..(459): a, c, t, g, unknown or other
  misc_feature (459)..(459): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggnaatgaataaatattacgcacgctccgtgaagggccgattcgccatctccagagacaatcaggacacgctgtacctggagatggacgcctgagacctgacgacacggactaagtttatactgtgcggtaggtttatggtgttggaacgtggaacccaaccgggaaaactgggtaccgaccccgtggggaccctacggggacccgttcgggtccgtccgtccttcggtctcgccctccgaccgaacggccctagtcccggtccttccccccgnggtcccgccccgtcgcccgtcccgacgggtacgacccgtacccgtcccggaagaccgccgaccgacgggcccggccccggttgggcccgttcgccccggttcggtaccgaaaacggggtcccttaaaccggttccctaacgggtaccgttgaacccgtggacggccggggtcgtacggacgaacggggccgaacg

SEQ ID NO: 357497 - DNA, 564 bp, Homo sapiens
  misc_feature: GZ8MTXP02F9V5J.13.12.B01.1.454.CMB.2.raw
  modified_base (199)..(199): a, c, t, g, unknown or other
  misc_feature (199)..(199): n is a, c, g, or t
  modified_base (564)..(564): a, c, t, g, unknown or other
  misc_feature (564)..(564): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatnttacgcacgctccgtgaagggccgattcgccatctccagagacaattccaggaacacgctgtacctggagagtggacggcctaggagacctgacgacacggctaaatttatactgtgcgtaggtttatgtgttggaacgtggtaccaccggtaaactggttaccgacccgtggggccaggggaccctggtcgtcgtctacgtctcgcctccaccacgggcccagtccggtcctccccgtggcccgccctgcctaccgaggacgaccgaccctccgagagccacgacgccggccgtggggctcgccgtcggtcaacgggctaaccttcgtacgtaccgtgaccgtgacgacggctcggacaggcgn

SEQ ID NO: 357498 - DNA, 657 bp, Homo sapiens
  misc_feature: GZ8MTXP02FKP3S.13.12.B01.1.454.CMB.2.raw
  modified_base (233)..(233): a, c, t, g, unknown or other
  misc_feature (233)..(233): n is a, c, g, or t
  modified_base (260)..(260): a, c, t, g, unknown or other
  misc_feature (260)..(260): n is a, c, g, or t
  modified_base (473)..(473): a, c, t, g, unknown or other
  misc_feature (473)..(473): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgaataaatattacgcacgctccgtgaaggccgattcgcatcncagagacatccaggacacgctgtaccnggagagtcggacgccgtggacgacctgaacgacacggtactaattttagtactggtagacggtaggtttatggtggttaggaaacggttcggtaacccgaaccgggtaaaacgtcgggttacccggacccggtggggaccgacggggtaccctggttccgtcgtctcgtctcgccctaccgaccgacggcctacgtcccgttccctcccccgngcccgcccgtcgcccgtacgacggcgtacccaccgtaccgaacggacacccgaacgcggtcccggtcccggtcggcgttccgacccgtacggtaaccgaaacggtacccttaaccgttaccgttaacggttaccgtacgtaaccgtcgggaacggccgggactacgggaccgaacggccgaacg

SEQ ID NO: 357499 - DNA, 618 bp, Homo sapiens
  misc_feature: GZ8MTXP02FQ1E0.13.12.B01.1.454.CMB.2.raw
  modified_base (264)..(264): a, c, t, g, unknown or other
  misc_feature (264)..(264): n is a, c, g, or t
  modified_base (397)..(397): a, c, t, g, unknown or other
  misc_feature (397)..(397): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccgagggaagggctggagtggttggcagtcatttcagatgatggcaatgataaatattacgcacgctccgtgaaggccattcgccatctccagagacaattccaaggaacacgctgtaccnggagagtggacgcctgagacctgacgacacggctaatttatactgtagcgtaggtttatgtgtggaacgtggtaaccaccggaaactcggttacgacccgtgggaccagggaccctggtccgtcgtctcgtcncgtccctccaacccgaacgggcccaagtcccggttaccctcccccgtggcccgtccccgtgcccgtaccgacggaccgacccgacccgttcccgaacggacgacccgaacgacggcccggtcccgtcggggcctcggccctcgggtacaaacgggtaccttaccttaccgtacgttaacgtcgaacgtaaggcggacgggccgtaggacgacggaccgacg

SEQ ID NO: 357500 - DNA, 710 bp, Homo sapiens
  misc_feature: GZ8MTXP02I3BA8.13.12.B01.1.454.CMB.2.raw
  modified_base (270)..(270): a, c, t, g, unknown or other
  misc_feature (270)..(270): n is a, c, g, or t
tcagtcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgaataaatattacgcacgctccgtgaaggcgattcgcatctccagagacaattccaggaacacgtctagtacctagganagtcggacggcctaggacgacctgaccgacgacggactaatttattacgtgtaggacggtagggtttactggttggtttacgggaaacggttcggtaacccgaaaccggtaaaacgttcgggttaccgaccccggttaggggacccgacgggggtaaccccttgggttaccggtaccgttccttccggttctcccgtaccctacccgaacccggtaaaccgggcccctacggttcccggtttccccgttccccccggcggtccccgtcccctacggtcctacccggacggtaccgacccgtacccgtaccggaacggaccgtaccacgacggcccgggtccgtcgggtacgtcgtcccgtacggtaccgaacggtaccttaaccgttccgtacgtacgtacgacgtaacggacggtcggacgtcggacgacggacgtacg

SEQ ID NO: 357501 - DNA, 534 bp, Homo sapiens
  misc_feature: GZ8MTXP01ESHJG.51.79.H02.1.454.CMB.2.raw
  modified_base (361)..(361): a, c, t, g, unknown or other
  misc_feature (361)..(361): n is a, c, g, or t
tcagcgatcgtatacacgaccggtgctcgatttagtgtcacacgaagggaaaggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctacacagtgataggaaacacctactgactggttcagcagaggcctggccaatctcaaggcgtcctttatttataaggtttctaagtcgggtactttggggtcccagacagacttcagcgcagtgggtcncgcactcacttcacactagaaatcagcgagggtggaggacgtaggtaggtagtttaggggttattacgtgctagtgacgaaaggtacacgacgtcggcctaccgtactacgtttggccgaggggaaccaagctacgagatacgaaacgacttgtaaggctgcacatcttgttc

SEQ ID NO: 357502 - DNA, 562 bp, Homo sapiens
  misc_feature: GZ8MTXP01CM5W2.51.79.H02.1.454.CMB.2.raw
  modified_base (294)..(294): a, c, t, g, unknown or other
  misc_feature (294)..(294): n is a, c, g, or t
tcagcgatcgtatacacgaccggtgctcgatttagtgtcacacgaagggaaaggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctacacagtgatggaaacacctacttgactggttcagcagaggcctggccaatctccaaggcnctttatttataaggtttctaatcgggactttggggcccagacagacttcagcggcaggtgggtcaagcaactcacttcaacactagaaaatcagcgagggtggaggctggaggtagtttaggggttattacgtgcagtgacaaggtacactacgtcggaccttccgtaactacgttttcggacccgacgggggaaccaaagccgtacggaagtaaacgttacaaaacggacttaggtcgggcttcggccaccttatcccttggttccc

SEQ ID NO: 357503 - DNA, 528 bp, Homo sapiens
  misc_feature: GZ8MTXP01BHC0M.51.79.H02.1.454.CMB.2.raw
  modified_base (251)..(251): a, c, t, g, unknown or other
  misc_feature (251)..(251): n is a, c, g, or t
  modified_base (361)..(361): a, c, t, g, unknown or other
  misc_feature (361)..(361): n is a, c, g, or t
  modified_base (510)..(510): a, c, t, g, unknown or other
  misc_feature (510)..(510): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctactgcaggtctagtcacagcctcctacacagtgatggaaacncctactgactggttcagcagaggcctggccaatctcaaggcgccttatttataaggtttctaagtcgggactttgggggcccagacagtacttcagcggcaggtgggtcncgcactcacttcacactagaaatcagcgagggtggaggcgtgaggtagtttaggggttattacgtgcagtgacaaggtacacactcggcctaccgtactacgtttggccgtagggaacctaagctcgagatacaaacgacttagtcggntcgcacactcgttgttcc

SEQ ID NO: 357504 - DNA, 576 bp, Homo sapiens
  misc_feature: GZ8MTXP01D21HV.51.79.H02.1.454.CMB.2.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (283)..(283): a, c, t, g, unknown or other
  misc_feature (283)..(283): n is a, c, g, or t
  modified_base (362)..(362): a, c, t, g, unknown or other
  misc_feature (362)..(362): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctanacagtnatgaaacactactgactggttcagcagagcctggccaatcnccaagcgtcctttaatttataaggtttcaagttcgggtactttggggtacccagacagtattcagcggcaggtgggtcncgcacgtcactcacactagaaatcagcgagggtggagacgtgtaaggtagtttaggggttattacgtagactaggttacgacgtaaagggtacacgtaaccgtcggtaccgttaccgttacgtacgttttacggccgaacggggaaccaaggttctacgaaggtaactaccgaaacgttcgttagtcggtactgaccaccttattcgttcgttc

SEQ ID NO: 357505 - DNA, 595 bp, Homo sapiens
  misc_feature: GZ8MTXP01DSLEN.51.79.H02.1.454.CMB.2.raw
  modified_base (288)..(288): a, c, t, g, unknown or other
  misc_feature (288)..(288): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctcctccctgcccgtcacccttggacaggcgcctccatctcctgcaggtctagtcacagcctcctacacagtgaataggaaacacctacttgactggttcagcagagctggccaatcncaagctcctttaatttataaggtttctaagttcgggtacttttgggggtcccaagacagtacttcaggcggcaggtcgggtcaacgcacctcacttcacactagaaatcgagcgagggtggaggtcgtaggtaggttagttttaggggttaatacgttagctagtgacgtaaacggtacaacgtaccgtcggtacccttaccggtacttaccgttttacgggacccgtaacgggggtaacccaaggccgttacggaagtaactaacgaaaacgttacttggtcggactgaccacattcttcgtttcc

SEQ ID NO: 357506 - DNA, 504 bp, Homo sapiens
  misc_feature: GZ8MTXP01A27X0.51.79.H02.1.454.CMB.2.raw
  modified_base (251)..(251): a, c, t, g, unknown or other
  misc_feature (251)..(251): n is a, c, g, or t
  modified_base (370)..(370): a, c, t, g, unknown or other
  misc_feature (370)..(370): n is a, c, g, or t
  modified_base (396)..(396): a, c, t, g, unknown or other
  misc_feature (396)..(396): n is a, c, g, or t
  modified_base (423)..(423): a, c, t, g, unknown or other
  misc_feature (423)..(423): n is a, c, g, or t
  modified_base (484)..(484): a, c, t, g, unknown or other
  misc_feature (484)..(484): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctacacagtgatggaaacnctacttgactggttcagcagaggctggccaatctcaaggcgccttatttataaggtttctaatcggactttgggggtcccagacagacttcagcggcagtgggtcaagcaactcacttnacactgaaaatcagcagggtgaggcngaggatttaggggttattatgcagtgnaaggtacacactgcctccgtactatttggccaggggaaccaagctcgagatacaaacgacngtggctgcaccatcgttgtc

SEQ ID NO: 357507 - DNA, 555 bp, Homo sapiens
  misc_feature: GZ8MTXP01BP7UB.51.79.H02.1.454.CMB.2.raw
tcagcgatcgtatacacgaccggtgctcgatttagtgtcacacgaagggaaaggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctacacagtgatggaaacacctactgactggttcagcagaggcctggccaatctcaagctccttatttataagtttctaagtcgggtactttggggtcccagacagacttcagcggcagtgggtcaacggcactcacttcacactagaaaatcgaagcgagggtggaggcgtaggaagggttagtttaggggtttattacgtgactaggtgacgtaaggtacacgacgtcggcccttaccggtactacgtttacggccgtagggggaaccaaggcgtacgagaactaacgaaacgttacttggtgggctggcacatcttgttcc

SEQ ID NO: 357508 - DNA, 617 bp, Homo sapiens
  misc_feature: GZ8MTXP01AT15G.51.79.H02.1.454.CMB.2.raw
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacacctatgactggttcagcagaggcctggccaatctccaaggcgtcctttatttataaggtttctaagtcgggtactttggggtcccagacagtacttcagcgcnggtgggtcncgcactcacttcacactagaaatcgagcgaggggtgaggacgtggaggtagtttaggggttattacgtgtactaggtgacgtaaaggtaccaacgtacgtcggtacccgttaccgtacgttaccgttttacgggacccggtaacgggggtaaccctaacggttccgtaccggaagtaacgtaaccgttaaaaccggttaccgttaggtaacgggtcttaacggaccctaccttacgttccgttcggtttcccg

SEQ ID NO: 357509 - DNA, 575 bp, Homo sapiens
  misc_feature: GZ8MTXP01EITV7.51.79.H02.1.454.CMB.2.raw
  modified_base (228)..(228): a, c, t, g, unknown or other
  misc_feature (228)..(228): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctcctccctgcccgtcacccttggacaggcgcctccatctcctgcaggtctagtcacngcctctacacagtgatggaaacacctacttgacttggttcagcagaggcctggccaatcctaccaaggcgtacctttatttaagtaaggttttctaagttcgggtactttggggaccctagacagtacttcgagcggcaggtcgggtcaacgcactctacttcacactagaaatcagcgagggtggaggactaggtaggtagtttagggttattacgtgcagtgacgtaaggtacacgtacgtcggtccttaccgtactacgtttcggacccgtaaggggaaccaaggcgtacgaagacttaacgaaacgttacgttggtggctcgacaccttattccgttgtttcc

SEQ ID NO: 357510 - DNA, 534 bp, Homo sapiens
  misc_feature: GZ8MTXP01B5OAS.51.79.H02.1.454.CMB.2.raw
  modified_base (250)..(250): a, c, t, g, unknown or other
  misc_feature (250)..(250): n is a, c, g, or t
  modified_base (289)..(289): a, c, t, g, unknown or other
  misc_feature (289)..(289): n is a, c, g, or t
tcagcgatcgtatacacgaccggtgctcgatttagtgtcacacgaagggaaaggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctacacagtgatggaaacnctactgactggttcagcagagcctggcaatctcaaggcnccttatttataaggtttctaagtcgggtactttgggggtcccagacagtacttcagcggcagtgggtcaacgcactcacttcacactagaaatcagcgagggtggaggcgtagtaaggtagtttaggggttattacgtgacagtgacaagtacacgacgtcggccttccgtactcgtttcggccgtaggggaaccaacgctacgagactacgaaacgacttagtggctggcacttagtcttgttc

SEQ ID NO: 357511 - DNA, 638 bp, Homo sapiens
  misc_feature: GZ8MTXP01DEGPM.51.79.H02.1.454.CMB.2.raw
  modified_base (410)..(410): a, c, t, g, unknown or other
  misc_feature (410)..(410): n is a, c, g, or t
  modified_base (616)..(616): a, c, t, g, unknown or other
  misc_feature (616)..(616): n is a, c, g, or t
tcagcgatcgtatacacgaccggtgctcgatttagtgtcacacgaagggaaagggggatcaggactcctcagttcaccttctcacaatgaggctccctgctcagcctccgtggggctgctaatgctcgtgggtcccaggatgcacgtggggatgttgtggtgactcagtctcctctctccctgcccgtcacccttggacaggccgcctccatctcctgcaggtctagtcacagcctcctacacagtgataggaaacacttacttgtactggttacagtcaagacggtcctcggacctaatccctaccgaaacggccgttaccttttaattttaagttaacggttttactaaacgtttcgggtacgttttcggggtacccagacagtacttcagcggctaggtcgggtacncgctacctctacttcaactacgtaagaaatcgaggacgaggggtggaggtcgtagggtaagggttaggtttaggggtttaattacgtagtacaggtagtacgtaaacgggttacacgtacgtcggtcccgttaccgttaacgttacgttttcggaccgtacggggaaccaacgcgtacgacgaactacaaacggttcttaggtcgntcgccacttacttcgttgttcc

SEQ ID NO: 357512 - DNA, 519 bp, Homo sapiens
  misc_feature: GZ8MTXP01ALEQQ.51.79.H02.1.454.CMB.2.raw
  modified_base (250)..(250): a, c, t, g, unknown or other
  misc_feature (250)..(250): n is a, c, g, or t
  modified_base (290)..(290): a, c, t, g, unknown or other
  misc_feature (290)..(290): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctctacacagtgatggaaacnctactgactggttcagcagagcctggccaatctcaaggcncttattataagtttcaatcgggactttgggggtcccagacagtacttcagcgcagtgggtcaacgcactcactcacactagaaatcagcgagggtggaggcgtggaggtagtttaggggtttattactgcagtgacgaaggtacacacgtgcctaccgtactcgtttgccgaggggaaccaagctacgagtacgtacaacgacttggtaaggctcgcacatcttgttcc

SEQ ID NO: 357513 - DNA, 588 bp, Homo sapiens
  misc_feature: GZ8MTXP01BC8NO.51.79.H02.1.454.CMB.2.raw
  modified_base (364)..(364): a, c, t, g, unknown or other
  misc_feature (364)..(364): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctacacagtgatggaaacacctacttgactggttcagcagaggcctggccaatctccaaggcgtccttatttataaggtttctaagtcgggtactttggggtcccagacagtacttcagcgcaggtgggtcncgcactcacttcacactagaaactcgagacgagggtcggaggacgtaggtaggttagtttaaggggtttattacgtgactaggttacgacgtaaacggtacacgtacgtcggtcccttaccgtacttacgtttcggaccgaggggaaccaagttcgtacgaagtacgtaaccgaaaacgttacgttacggtcggtaccgtcgacctacttacttcgttcgttcc

SEQ ID NO: 357514 - DNA, 524 bp, Homo sapiens
  misc_feature: GZ8MTXP01ACPTD.51.79.H02.1.454.CMB.2.raw
  modified_base (242)..(242): a, c, t, g, unknown or other
  misc_feature (242)..(242): n is a, c, g, or t
  modified_base (273)..(273): a, c, t, g, unknown or other
  misc_feature (273)..(273): n is a, c, g, or t
  modified_base (290)..(290): a, c, t, g, unknown or other
  misc_feature (290)..(290): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctacacagtnatggaaacacctacttgactggttcagcagngctgccatctcaaggcncttattataggtttctaagtcggtactttgggaccagacagactcagcgcagtcgggtcaacgcactcacttcacactagaaactcagcgagggtggaggcgtggaggtagtttaggggttattacgtgcagtgacgaaggtacacacgtcggccttaccgtactacgtttcggccgtaggggaaccaagttcacgagactacgaaacgacttgtggctgccaccatcttgtcc

SEQ ID NO: 357515 - DNA, 553 bp, Homo sapiens
  misc_feature: GZ8MTXP01DKAZ5.51.79.H02.1.454.CMB.2.raw
  modified_base (371)..(371): a, c, t, g, unknown or other
  misc_feature (371)..(371): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgataggaaacacctacttgactggttcagcagaggcctggccaatctaccaaggcgtacctttaatttaataaggtttctaagtcgggtactttggggtcccagacagacttcagcggcaggtgggtcncgcactcacttcacactagaaatcagacgagggtggaggcgtaggtaggtagtttaggggttattacgtgcagtgacgaagtacactacgtcggacctaccgtactacgtttacggaccgtaaggggaaccaagctacgagactacaaacgacttggtggctcgcacttactcgttcgttcc

SEQ ID NO: 357516 - DNA, 609 bp, Homo sapiens
  misc_feature: GZ8MTXP01EM46M.51.79.H02.1.454.CMB.2.raw
  modified_base (243)..(243): a, c, t, g, unknown or other
  misc_feature (243)..(243): n is a, c, g, or t
  modified_base (372)..(372): a, c, t, g, unknown or other
  misc_feature (372)..(372): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggccgcctccatctcctgcaggtctagtcacagcctcctacacagtnatggaaacacctatgactggttcagcagaggcctggaccaatctaccgaaggcgtacctttatttataaggttttctaagttcggtacgtttggggtcccagacagacttcgagcggcaggtcgggtcncgctactcacttcacactagaaatcgagcgagggtggaggcgtaggtaggtagtttaggggttattacgtgtacaggttgacgtaaggtacacgtacgtcggtaccctaccgttactaccgttttacgggccgtaacgggggaacctaaggccgttacggaacgtaacgtaacgaaaacggttaacgttcggtaacggggcttaacggaccctaccgttattccgttcggttttccc

SEQ ID NO: 357517 - DNA, 570 bp, Homo sapiens
  misc_feature: GZ8MTXP01D27V7.51.79.H02.1.454.CMB.2.raw
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (393)..(393): a, c, t, g, unknown or other
  misc_feature (393)..(393): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctcctccctgcccgtcacccttggacaggcgcctccatctcctgcaggtctagtcacagcctcctacacagtgatggaaacacctactgacttggttcagcagaggcctggccaatctacaaggctcctttaatttataaggtttctaagttcgggtacgtttcgggggtacccagacagtacttcagcggnaggtgggtcncgcactcacttcaactactanaaatcagcgagggtgaggctaggaggtagtttagggttatacgtgctagtgtacgtaaggtacacacgtcgtacctaccgttacgtaccgttttacggaccggtaaggggaaccaagttccgtacgagtaaacgtacgaaacgacgttagtggtactcgacacattcttcgttaacc

SEQ ID NO: 357518 - DNA, 561 bp, Homo sapiens
  misc_feature: GZ8MTXP01DJ3J7.51.79.H02.1.454.CMB.2.raw
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
tcagcgatcgtatacacgaccggtgctcgatttagtgtcacacgaagggaaaggggatcaggactcctcagttcaccttctcacaatgaggctccctgctcagctcctggggctgctaatgctctgggtcccaggatgcactggggatgttgtggtgactcagtctcctctctccctgccccgtcacccttggacaggccggcctccatctcctgcaggtctagtcacagcctcctacacagtgatggaaacacctacttgacttggttcagcagaggcctggccaatctccaagcgcctttatttataggtttctaagttcgggtactttggggtcccagacagacttcagcggnaggtgggtcncgcactcacttcacactagaaatcgagcgagggtggaggtcgtggtaggtagtttaggggttattacgtgctagtgacgaaggtacacgtacgtcggtcctaccgtacgtacgtttcggccgtaacgggggaaccaacggcgtacgagtactacgaaaacgttacgttggtaaggctcgcaccattcttcgttcc

SEQ ID NO: 357519 - DNA, 600 bp, Homo sapiens
  misc_feature: GZ8MTXP01B2PQH.51.79.H02.1.454.CMB.2.raw
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctacacagtgatggaaacactacttgactggttcagcagacggcctggaccatctaccgaaggtcgtacctttaatttagtaaggttttctaagttcgggtacgtttgggggtacccagacagtacttacgaggcggctaggtcgggtcaacggcacgtcaccttcactactagaaatcgagcgaggggtcggaggctaggaggttagtttaggggttatacgtgacaggtgacgtaaggtacacgtacgtcggccttaccgtacttacgtttcggaccgaaggggaaccaaggttcctacggagtaacgtaacgaaaacgttacgttggtaacggtcctaagaccaccttagttccgttcgttaacc

SEQ ID NO: 357520 - DNA, 576 bp, Homo sapiens
  misc_feature: GZ8MTXP01BFTQN.51.79.H02.1.454.CMB.2.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcaccttggacnggcgcctccatctcctgcaggtctagtcacagcctcctacacagtgataggaaaccncctattgacttggttcagcagaggcctggccaatctaccgaaggcgtacctttaatttataaggttttctaaagttcgggtacgtttggggtacccagacagtacttcaggcggcaggtgggcaacgcaactcctacttcacactagaaactgagcgagggtggaggtcgtaggtaaggttagtttagggttacttagtgtacagttgacgtaacggtacacacgtcggtacctaccgtacttacgtttcggaccgaaggggtaaccaagttcgtacgaagtactaacaaacgttacttgtaaggctcgcacttatcttgttcc

SEQ ID NO: 357521 - DNA, 589 bp, Homo sapiens
  misc_feature: GZ8MTXP01DYJX1.51.79.H02.1.454.CMB.2.raw
  modified_base (375)..(375): a, c, t, g, unknown or other
  misc_feature (375)..(375): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctacacagtgataggaaacctacctacttgacttggttcagcagaggcctggaccaatctccgaaggcgtacctttatttataaggtttctaagttcgggtacgtttcggggtacccagacagtacttcagcgcagtgggtcncgcactcacttcacactagaaatcagcgaggggtgaggcgtaggaggttagtttaggggtttattacgtgacagtgacgtaaggtacaacgtacgtcggaccttaccgttactaccgttttcggacccgtaagggggaaccctaggccttacggaagtaacgtaacgaaaacgttaccgttggtcggactcgaccacttacgttcttcgtttcc

SEQ ID NO: 357522 - DNA, 562 bp, Homo sapiens
  misc_feature: GZ8MTXP01EFZZL.51.79.H02.1.454.CMB.2.raw
  modified_base (243)..(243): a, c, t, g, unknown or other
  misc_feature (243)..(243): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtnataggaaacacctattgactggttcagcagaggcctggaccaatcctccgaaaggccgtacctttaattttaagtaaggttttctaaagttcggggtacttttgggggtccccagacagtacttcagcgcaggtgggtcaacgcactcacttcaacactagaaatcagacgagggtggaggtacgtaggtaaggtagtttaggggttattactgtcaggtgacgtaaaggtacacgacgtcggcctcgtactacgtttgccgtaggggaaccaagctacgagataacaaacgacttgtggactgcaccatcgttgttcc

SEQ ID NO: 357523 - DNA, 556 bp, Homo sapiens
  misc_feature: GZ8MTXP01ADBVE.51.79.H02.1.454.CMB.2.raw
  modified_base (546)..(546): a, c, t, g, unknown or other
  misc_feature (546)..(546): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctacacagtgataggaaacacctacttgactggttcagcagaggcctggccaatctccaaggcgtaccttattataaggtttctaagtcgggtactttggggcccagacagacttcagcggcagtgggtcaacgcactcacttcacactagaaatcagcgaggggtgaggctggaggtagttttaggggttattacgtgcagtggacgaaggtacacgtacgtcggacccttaccggtaactcgttttcgggaccgagggggaacccaaggttcctacggatacgtacgaaacgacttgtggactgaccacttntcttcgttcc

SEQ ID NO: 357524 - DNA, 588 bp, Homo sapiens
  misc_feature: GZ8MTXP01C1SZI.51.79.H02.1.454.CMB.2.raw
  modified_base (438)..(438): a, c, t, g, unknown or other
  misc_feature (438)..(438): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggccgcctccatctcctgcaggtctagtcacagccctcctacacagtgaataggaaaccacctacttgacttggttcagcagacggcctggaccaatcctaccaaggccgtacctttaatttaactaaggttttctaaagttcggggtaacgttttgggggtaccccaagtacaggtacttcgaggcggctaggtcgggtcaacggcactcacttcacactagaaatcagcgagggtgaggngtagtaggtagtttagggttattacgtgactagtgacgtaaaggtacacgacgtcggtacctaccgtactacgtttcggaccgtaggggaaccaagcgtacgagtactacgaaacgacgttacgtggactcgacaccttatcttcgttcc

SEQ ID NO: 357525 - DNA, 568 bp, Homo sapiens
  misc_feature: GZ8MTXP01BJW6J.51.79.H02.1.454.CMB.2.raw
  modified_base (228)..(228): a, c, t, g, unknown or other
  misc_feature (228)..(228): n is a, c, g, or t
  modified_base (466)..(466): a, c, t, g, unknown or other
  misc_feature (466)..(466): n is a, c, g, or t
  modified_base (549)..(549): a, c, t, g, unknown or other
  misc_feature (549)..(549): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacanccggtcctacacagtgatggaaacacctacttgactggttcagcagaggcctggaccaatctaccaaggtcgtcctttatttaataacggttttctaagtcgggtacgtttcgggggtcccagacagacttcgagcggcaggtgggtcaacgcactcacttcacactagaaatcagcgagggtggaggcgtaggtaggtagtttaggggttattacgtgcagtgacgaaggtacaacncgtcgcctaccgtactacgtttcggccgtaggggaacctaagcgtacgaggaactacgaaacgcgttagtaagggtctgaccncgttactcgttcgttaacc

SEQ ID NO: 357526 - DNA, 657 bp, Homo sapiens
  misc_feature: GZ8MTXP01AJ7N9.51.79.H02.1.454.CMB.2.raw
  modified_base (243)..(243): a, c, t, g, unknown or other
  misc_feature (243)..(243): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagccctcctacacagtnataggaaaccaccttactgtacttggttcagtcagaggcctggccaatctaccgaaggtccgtacctttaatttaattaaggtttctaaagttcgggtacgtttggggacccaagacagtacttcgaggcggacaggtcgggtacaacgctaacctcgtaacttcaactaacgtagaaaactcgaagcgaggggtcgagggtctaggtaaggttaggttttaaggggttacttacgtgtacgtaggtacgtaacgtaaacgggtacctacgtaacgtcggtcccgttaccgtacgttaacgttttcggaccggaacgggggtaacccaaggccgtacgaacgtaactaacgaaaccggttaacgttcggtaacgggtctaacgtaccaccgttaagttccgttaacgtttcccg

SEQ ID NO: 357527 - DNA, 861 bp, Homo sapiens
  misc_feature: GZ8MTXP01A4EEU.51.79.H02.1.454.CMB.2.raw
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcacgtggggatgttgtggtgactcagtctcctctcctccctgcccgtcacccgttggacaggccgcctccatctcctgcaggtctagtcacacgcctcctacacagtgaagtacggaaacctaccttagttgtacttggttcagtcgagacggcctaggacctaatcctacccgaaaggtccgtaccttttaaagtttaacgttaaacggttttcctaaacggtttccgggggttaaccgttttcgggggaaccccctaaggtacctaaacgggttaactttccggaaagggtcccggggtaacgtaaggggttccgggggttaacccaacccgggtacctaaacccgtttacccgttaaaccctttacccaaaccgttaaaccgtaaacgggtaaaaaaactttccggaacgggaccggtaaagggggggttaggaaacggggttaccggtttaaagggggttaaacggggtttaacgggttttttaaaggggggttttaacttaaaccggttggtaaccgttaaggggttacggaaaccggtaaacgggtttaaccaaccggtaaacgttccggtaacccgttacccgtacgttaacggttttcgggacccgaacgggggtaaccaacgttcgtacggttaaacgaactaaccgttaaacgttacgttcgggtcggtacttccggaccctaacccttagtttccgttcgttttaaccccg

SEQ ID NO: 357528 - DNA, 564 bp, Homo sapiens
  misc_feature: GZ8MTXP01AWNQU.51.79.H02.1.454.CMB.2.raw
  modified_base (366)..(366): a, c, t, g, unknown or other
  misc_feature (366)..(366): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacacgcctcctacacagtgataggaaacactactgacttggttcagcagacgcctggccaatctccaaggctaccttattagtagtttcaagtcgggtacttttgggggacccagacagtacttcgagcggcaggtcgggcncgcactcacttcacactagaaatcgagcgagggtaggaggcgtaggaggtagtttaggggtttatacgtgacgagttggacaagggttacacacgtcggccttaccgtatacgtttacggacccgaaggggaaccctaaggcctagacggtaactacgaaacgcttaggcggctcgacacccgttatcttgttaaccc

SEQ ID NO: 357529 - DNA, 564 bp, Homo sapiens
  misc_feature: GZ8MTXP01BKSBY.51.79.H02.1.454.CMB.2.raw
  modified_base (251)..(251): a, c, t, g, unknown or other
  misc_feature (251)..(251): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctacacagtgatggaaacnctattgacttggttcagcagagcctggccaatctaccaaaggtcgtaccctttaatttaataacggttttcaaagttcggggtaacttttgggggaccccaagtaccaggtacttcaggcggcaggtcgggtcaacggcacgtcacttcactactagaaatcagtcgagggtgaggctaggaggtagtttaggggttatacgtgcaggtgacgaaggtacactacgtcgccgtaccggtactcgtttcggccgtaggggaaccaagcgtcgagatacgaaacgacttgtcggactgcacttatcttaacgtcc

SEQ ID NO: 357530 - DNA, 784 bp, Homo sapiens
  misc_feature: GZ8MTXP01A36B1.51.79.H02.1.454.CMB.2.raw
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctcctccctgcccgtcacccttggacaggccggcctccatctcctgctaggtctagtccacacgccctcctacacagtgactacggaaacctacctacgttgtacttggttcagtcgaggacggcctggacctaagtcctaccgaacggtccgttacccttttaagtttaacgttaaacggttttacgtaaacgtttccgggggttacgttttcgggggaccctaggaactaggtacctttcgaaggtccgggtcgtagggttcggggtacccaacggcctaaccgttcctaacctttaccaaccgtaaacgttaaggaaaaacttcccgaaagggaccgggtaagggggtggaacgggtacgttaggggttaaacgggtttaagggtttttaagggggtttaacttacggtagtacgtaaggggttacgaacggtaaacgggtaccaacgtacggttccgggtaccctttaccggtaacctttaaccgggtttcgggaacccggtaacgggggtaaccctaacggttccgtaacggaacgtaaacgtaacccggaaaacgttacgttcgggtaacgtccgttaacgacctaacgttcttcgttaacgtttccc

SEQ ID NO: 357531 - DNA, 618 bp, Homo sapiens
  misc_feature: GZ8MTXP01E12SL.51.79.H02.1.454.CMB.2.raw
  modified_base (434)..(434): a, c, t, g, unknown or other
  misc_feature (434)..(434): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcaccttggacaggcgcctcatctcctgcaggtctagtcacagccctctacacagtgataggaaacacctacttgactggttcagcagaggcctggccaatcctaccaaggcgtccttatttataaggtttctaaagtcgggtacttgggggtcccagacagacttcagcggcaggtagggtcaacgccactcacttcacactagaaatcaggcgagggtggaggctggagtagtttaggggttattacgngcagtgacgaaaggtaccacgtaccgtcggtacccttacccggtaacctaaccgttttcgggacccggtaaacgggggaaccccgtaaacggccgttaccgggaacggtaaactaccgaaaaaccggaaacgttcgggttaagggaccttcggaccacccttacgttcccttcggtttaacccc

SEQ ID NO: 357532 - DNA, 649 bp, Homo sapiens
  misc_feature: GZ8MTXP01A7XQ8.51.79.H02.1.454.CMB.2.raw
  modified_base (196)..(196): a, c, t, g, unknown or other
  misc_feature (196)..(196): n is a, c, g, or t
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacnggcgcctcatctcctncagtctagtcacagcctactacacagtnaataggaaactcctattgtactggttacagtcaggacgcctggacctaatcctaccgaaggtccttacctttaagttttaacttaaagggtttttactaaacggtttcggggttacgttttcgggggaccctagactagtacttcggagcggactaggtcgggactaacggcctacctactacttaccgaactacttaaggaaactcgaggtcgaaggggtggaggtacgtaggtaaggttagttttagggttatagagtacagttcgacgtaagtaacacacgtcggtacttccgtattaccggtttcggacggaccggggtaacaacgttccgaagaacgtaacgtaacgaaaacggttcttgggttaacgacccgtgtaccctacgttactttcgttcggtttccc

SEQ ID NO: 357533 - DNA, 774 bp, Homo sapiens
  misc_feature: GZ8MTXP01A8OBP.51.79.H02.1.454.CMB.2.raw
  modified_base (545)..(545): a, c, t, g, unknown or other
  misc_feature (545)..(545): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcacgtggggatgttgtggtgactcagtctcctctcctccctgcccgtcacccgttggacaggccgcctccatctcctgctaggtctagtccacgacgtccctacctaacaccgtaaggttcgtaatacgggtaaaaccctaccgttacttacggtaaccgtttgggtttacaacggtcaaacgggtaacgggtccccttagggaccctaaagtttccccgtaccgtaaaacggggccgtttaacccttttaaagtttttaaagttaaaacgggtttttctaaacgggtttccgggggttaaccgttttacgggggtacccaaaggtacaacggtaccttcggacgtcgggactagggtcgggtacaacgccaaaccttcgacttaccgaacacgtaaacgtaaacncgtaacggacggagggtacgggtaggacgttaggtaggttaaggtttagggtttacttagtagtacgtagtacgacgtaaggtaaccgacgtacgtcgtaccgttaccgtaccgtacgtttaccggacggtaacgggtaaccgtaacgttacgtacggagaaacgttaccgaaacgttacggttacggtaacgggtctaacgacgtaccttacgtttcgttcgtttccg

SEQ ID NO: 357534 - DNA, 516 bp, Homo sapiens
  misc_feature: GZ8MTXP02JP2LH.51.79.H02.1.454.CMB.2.raw
tcagcgatcgtatacacgaccggtgctcgatttagtgtcacacgaagggaaaggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacacctacttgacttggttcagcagaggcctggccaatctccaaggcgccttatttataaggtttctaatcgggtactttggggcccagacagacttcagcggcagtgggtcacgcactcacttcacactgaaaatcagcagggtgagctgaggtatttaggggttattacgtgcatgacaaggtacacacgtggcctcgtactacgtttggccgtaggggaccaagctacgagactacgaaacgaactgtggctagcaccatctgtc

SEQ ID NO: 357535 - DNA, 512 bp, Homo sapiens
  misc_feature: GZ8MTXP02JEYAT.51.79.H02.1.454.CMB.2.raw
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacacctattgacttggtttcagcagaggcctggccaatctccaaggcgccttatttataaggtttctaagtcgggactttggggtcccagacagattcagcgcagtgggtcacgcactcacttcacactgaaaatcagcgagggtggagctggagtagtttaggggttatacgtgcatgcaaggtacacacgtgcctcgtactactttggacaggggaccaagctcgagactacaaaacgactggngcncacactactctgtc

SEQ ID NO: 357536 - DNA, 557 bp, Homo sapiens
  misc_feature: GZ8MTXP02H6E0J.51.79.H02.1.454.CMB.2.raw
  modified_base (235)..(235): a, c, t, g, unknown or other
  misc_feature (235)..(235): n is a, c, g, or t
  modified_base (288)..(288): a, c, t, g, unknown or other
  misc_feature (288)..(288): n is a, c, g, or t
  modified_base (346)..(346): a, c, t, g, unknown or other
  misc_feature (346)..(346): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
tcagcgatcgtatacacgaccggtgctcgatttagtgtcacacgaagggaaaggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctanacagtgatggaaacactactgacttgttcagcagagctggccaatctcaagcnccttattataagtttctaagtcggtactttggggccagacagctcagcgcagtggtcncgcactcacttcacactagaaacnagacgagggnggagcgtaggtaggttagtttagggttatacgtgtatagtagagtaagtacacgtacgtcgtaccgttaccgtacgttacgtttacggaccgtaacggggtaccaacggtccgtacgaacgtaactaacgaaaacgtacgtaggtaacgactacgacctactacgttacgttacgtc

SEQ ID NO: 357537 - DNA, 616 bp, Homo sapiens
  misc_feature: GZ8MTXP02FRD7G.51.79.H02.1.454.CMB.2.raw
  modified_base (252)..(252): a, c, t, g, unknown or other
  misc_feature (252)..(252): n is a, c, g, or t
  modified_base (289)..(289): a, c, t, g, unknown or other
  misc_feature (289)..(289): n is a, c, g, or t
  modified_base (366)..(366): a, c, t, g, unknown or other
  misc_feature (366)..(366): n is a, c, g, or t
tcagcgatcgtatacacgaccggtgctcgatttagtgtcacacgaagggaaaggggatcaggactcctcagttcaccttctcacaatgaggctccctgctcagctcctggggctgctaatgctctgggtcccaggatgcactggggatgttgtggtgactcagtctcctttctctccctgcccgtcacccttggacaggcgcctccatctcctgcaggtctagtcacagcctcctacacagtgatggaaacncctacttgacttggttcagcagaggcctggccaatcncaaggctctttatttataaggtttctaagtcgggtacgtttcggggtacccagacagacttcagcggcaggtggtcncgcactcacttcaacactagaaaatcagcgagggtggagctgaggtagtttaggggttattacgtgacagtacgacgtaaggtacacgtacgtcggtacccttaccgttaacgtaccgttttacgggacccgtaaacggggtaaccgaaggtaccgttaacggaaacggtaacttaaccgaaaaaccggtaaccgttggtaacgggtaccttacggacccgtaacccgtaagttccttacggtttacccc

SEQ ID NO: 357538 - DNA, 601 bp, Homo sapiens
  misc_feature: GZ8MTXP02HU8ZC.51.79.H02.1.454.CMB.2.raw
  modified_base (298)..(298): a, c, t, g, unknown or other
  misc_feature (298)..(298): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgataggaaacacctacttgacttggttcagcagaggcctggccaatctccaaggcnccttatttataaggtttctaagtcggtactttggggcccagacagacttcagcgcagtggtcacgcactcacttcacactagaaatcagcgagggtggagcgtaggaggtagtttaggggttattacgtgactagttagagtaaaggtacacgtacgtacggtacccttaccgtacttaccgttttcgggacccgtaacgggggacccaaaggtccttaccggaaggtaaactaaccgaaaaccggtaaccgttaggtaacgggtactacggacccaaccgtacgttacctttcggtttaccc

SEQ ID NO: 357539 - DNA, 547 bp, Homo sapiens
  misc_feature: GZ8MTXP02G7T1A.51.79.H02.1.454.CMB.2.raw
  modified_base (252)..(252): a, c, t, g, unknown or other
  misc_feature (252)..(252): n is a, c, g, or t
  modified_base (297)..(297): a, c, t, g, unknown or other
  misc_feature (297)..(297): n is a, c, g, or t
  modified_base (367)..(367): a, c, t, g, unknown or other
  misc_feature (367)..(367): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacncctactgacttggttcagcagaggcctggccaatctaccaaggcncctttaatttataaggtttctaaagttcgggtactttcggggcccagacagacttcagcgcaggtggtcncgcactcacttcacactagaaaatcagcgagggtggagctaggaggtagtttaggggttatacgtgctagtgacaaaggtacacacgtggaccttaccgtactacgtttcggacgaacggggtaccaaggctacgagactacgaaaacgtacgtgtaaggctacgacacctatctcgttc

SEQ ID NO: 357540 - DNA, 513 bp, Homo sapiens
  misc_feature: GZ8MTXP02I1IR8.51.79.H02.1.454.CMB.2.raw
  modified_base (251)..(251): a, c, t, g, unknown or other
  misc_feature (251)..(251): n is a, c, g, or t
tcagcgatcgtatacacgaccggtgctcgatttagtgtcacacgaagggaaaggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacncctacttgacttggtttcagcagaggcctggccaatctccaaggcgccttatttataaggtttctaatcggactttggggcccagacagacttcagcggcagtcgggtcacgcactcacttcacactagaaatcagcagggtggaggctgaggtagtttaggggttattactgcatgcaaggtacacacgtgcctcgtactacgtttgcgagggaccagctcgagactacgaaacgactagtggctcgacacactctagttc

SEQ ID NO: 357541 - DNA, 574 bp, Homo sapiens
  misc_feature: GZ8MTXP02F6F8R.51.79.H02.1.454.CMB.2.raw
  modified_base (293)..(293): a, c, t, g, unknown or other
  misc_feature (293)..(293): n is a, c, g, or t
  modified_base (366)..(366): a, c, t, g, unknown or other
  misc_feature (366)..(366): n is a, c, g, or t
  modified_base (400)..(400): a, c, t, g, unknown or other
  misc_feature (400)..(400): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatacggaaaaccacctacttgacttggttcagcagaggcctggccaatcncaaggctacttatttataaggtttctaagtcggtactttcggggccagacagtactcgagcgcaggtcggtcncgcactcacttcacactagaaatcagcgtagggngagcgtaggtaggttaaggttttagggttaattcgtagacgtagttcgaacgtaacggtacaacgcgttacggtaccctacgttacgtcgtttacgggacggacgggtaaccaacggtctaacggaagtactaacgaaaacgtcgtaggcgctacgaccagtactcttcgttac

SEQ ID NO: 357542 - DNA, 600 bp, Homo sapiens
  misc_feature: GZ8MTXP02IAI5U.51.79.H02.1.454.CMB.2.raw
  modified_base (250)..(250): a, c, t, g, unknown or other
  misc_feature (250)..(250): n is a, c, g, or t
  modified_base (367)..(367): a, c, t, g, unknown or other
  misc_feature (367)..(367): n is a, c, g, or t
  modified_base (401)..(401): a, c, t, g, unknown or other
  misc_feature (401)..(401): n is a, c, g, or t
tcagcgatcgtatacacgaccggtgctcgatttagtgtcacacgaagggaaaggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctacacagtgatggaaacncctatgacttggttcagcagaggcctggcccaatcctaccgaaaggcctacctttaatttagtaaaggttttctaaagtcgggtaactttggggccctaagacagacttcgaggcgnagtgggtccacgctactttacttccaactactanaaaactaccagacgagggtggaggcgtaggtaggtagttttaaggggtttattacgtgactagtgacgtaagtacacgacgtcgaccgtaccgtactacgttttacggaccgtaacggggaaccgtaacgcgtaccgaagtaacgtaacgaaaacgtacgtaggtaggaacgtcgacactactccgtacgttacttccg

SEQ ID NO: 357543 - DNA, 550 bp, Homo sapiens
  misc_feature: GZ8MTXP02HYD2N.51.79.H02.1.454.CMB.2.raw
  modified_base (282)..(282): a, c, t, g, unknown or other
  misc_feature (282)..(282): n is a, c, g, or t
  modified_base (345)..(345): a, c, t, g, unknown or other
  misc_feature (345)..(345): n is a, c, g, or t
tcagcgatcgtatacacgaccggtgctcgatttagtgtcacacgaagggaaaggggatcaggactcctcagttcaccttctcacaatgaggctccctgctcagctcctggggctgctaatgctctgggtcccaggatgcactggggatgttgtggtgactcagtctcctctctcctgcccgtcaccttggacaggcggcctccatctcctgcaggtctagtcacagcctcctacacagtgatggaaacacctactgacttggttcagcagagctgccaatcncagcacttattataagttctaagtcggtacttggggccagacagactcagcggcaggtggtcncgcactcacttcacactagaaatcagcgagggtggagcgtaggaggtagtttaagggtttattactagactagtagacgaaggtacacacgtcggcctaccgtacgtacgttttacggaccgtaacggggaccaacgacgtacgaagaactaaccgaaaacgtaacgtcggtaacggcgtacgaccaacctactactacgtttcc

SEQ ID NO: 357544 - DNA, 605 bp, Homo sapiens
  misc_feature: GZ8MTXP02JAXX6.51.79.H02.1.454.CMB.2.raw
  modified_base (581)..(581): a, c, t, g, unknown or other
  misc_feature (581)..(581): n is a, c, g, or t
tcagcgatcgtatacacgaccggtgctcgatttagtgtcacacgaagggaaaggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctcatctcctgcaggtctagtcacagcctcctacacagtgataggaaacaccttacttgacttggtttcagtcaggaggcctggaccaaatcctaccgaaaggtccgtacctttaatttaacgttaacggtttactaaagttcgggtacgtttcggggtaccccaaggtactagtaacttcgagcggacgtaggtcgggacaccggctacctctaaccttcaactaactagaaaaactcgaaagcgaaggggtgaaggtcgtaggaaggttagtttaggggtttatacgtgactagtgacgtaaggtacacgactcggacctcgtactcgtttacggacgacggggtacacggtctacgaagactaccgaaaacgattcgngctacgactacactcctagttacc

SEQ ID NO: 357545 - DNA, 575 bp, Homo sapiens
  misc_feature: GZ8MTXP02GW0DL.51.79.H02.1.454.CMB.2.raw
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctacacagtgataggaaacacctactgacttggttcagcagacggcctggaccaatcctaccgaaaggtccgtacctttaatttaagttaaacggttttctaaaagttccggggtaacttttcggggtaccccaaggaccaggtaactttccgaggcggacaggtcgggtcacgcactcacttcaacactagaaaatcagcgagggtggagctagaggtagtttagggttatacgtgcatgacgaaggtacacacgtcgcctcgtactacgtttcggacgacggggaactaagctacgagaactacgaaacgtactgtaacgcgtacgacacactctacttcc

SEQ ID NO: 357546 - DNA, 590 bp, Homo sapiens
  misc_feature: GZ8MTXP02JOX3M.51.79.H02.1.454.CMB.2.raw
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagccctcctacacagtgatggaaacacctacttgacttggttcagcagacggcctggccaatctaccgaaggcgtcctttaatttataaggtttctaagtcgggtactttcggggtacccagacagacttcgagcggacaggtgggtcacgcactcacttcacactagaaatcgagacgagggtggaggctaggaaggtagtttaaggggtttattaacgtgactagtgacgaaggtacagacgtcgaccgttacgtacttacgtttacggaccgtaacgggaccgagtaccgtacgaagtacgtaacgaaaaccggtaacgtaggtaacgtcgtacggacctaacgtactcgtcgtttaccc

SEQ ID NO: 357547 - DNA, 523 bp, Homo sapiens
  misc_feature: GZ8MTXP02FV10D.51.79.H02.1.454.CMB.2.raw
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaaacacctacttgacttggttcagcagaggcctggccaatctccaaggcgcctttatttataaggtttctaaagtcgggtactttggggtcccagacagattcagcggcaggtggtcacggcactcacttcactactagaaatcagcgaggtggagctgagtagtttagggttatacgtgcatgacaaggtacanacgngcctcgtactacgtttgcgagggacaagctacgagactacgaaacgaacgtgtaaggctacgacaccatctgttac

SEQ ID NO: 357548 - DNA, 585 bp, Homo sapiens
  misc_feature: GZ8MTXP02HV82J.51.79.H02.1.454.CMB.2.raw
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctcctccctgcccgtcacccttggacaggccggcctccatctcctgcaggtctagtcacagccctcctacacagtgatggaaacacctactgtacttggttcagcagacggcctggaccaatcctccgaaggccgtcctttaatttattaaggtttctaagtcgggtacgtttcggggacccagacagtcttacgagcggctaggtcgggtcacgcactcaccttacaccactagaaaatcaagcgaggggtggaggctaggaggttagtttaggggtttatacgtgactagtgacgtaaagggtacacgtatcggtacccttaccggtactacgtttcggaccgtaggggaccaagtctacgagactacgaaaaccgtcgtgtaacggtctacgaccaactcgttctacgttcc

SEQ ID NO: 357549 - DNA, 526 bp, Homo sapiens
  misc_feature: GZ8MTXP02F7Y24.51.79.H02.1.454.CMB.2.raw
  modified_base (252)..(252): a, c, t, g, unknown or other
  misc_feature (252)..(252): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
  modified_base (521)..(521): a, c, t, g, unknown or other
  misc_feature (521)..(521): n is a, c, g, or t
tcagcgatcgtatacacgaccggtgctcgatttagtgtcacacgaagggaaaggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaaacncctactgacttggttcagcagagcctggccaatctcaaggcgcctttattataaggtttctaaagtcgggacttttggggcccaggacagattcagcggcagtgggtcacgcactcaccttcaacactagaaaatcagcaagggtgaagcngaggtntttaggggttatntgcatagnaaggtacacactgcctccgtanacgtttgccgagggaccaaagctacgaagaactacgaaaacgacgtagtcggactggaccacactcgtntttcc

SEQ ID NO: 357550 - DNA, 593 bp, Homo sapiens
  misc_feature: GZ8MTXP02I69NG.51.79.H02.1.454.CMB.2.raw
  modified_base (253)..(253): a, c, t, g, unknown or other
  misc_feature (253)..(253): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgataggaaacncctacttgacttggttcagcagaggcctggccaatctccaaggcgtacctttatttataaggtttctaaagttcgggtactttcggggtcccagacagtacttcgaggcggcaggtcgggtcacggcactcacttcaacactagaaaatcagacgaggggtgaggctaggaggttagtttaggggtttattacgtgtacgatcgtagaacggttacaccgtaccgcggtacctaccgtacttacgttcggacggtacggacgtacgtcgtacgacgtaactaaccgtaaacgtacgtaggtcgtacgtacgtaacccactaacgtccgttacgtttaccc

SEQ ID NO: 357551 - DNA, 568 bp, Homo sapiens
  misc_feature: GZ8MTXP02GXFXR.51.79.H02.1.454.CMB.2.raw
  modified_base (252)..(252): a, c, t, g, unknown or other
  misc_feature (252)..(252): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacncctactgacttggttcagcagaggcctggccaatctaccgaaggcgacctttaatttaataagggtttctaaagtcgggtactttggggaccctagacagacttcagcggcaggtcggtcacgcactcgacttcaacactagaaaatcagacgagggtaggagcgtagaaggtaagtttaaggggttattaacgtgactagtagacaaggtacacgacgtaggcctaccgtactacgtttcggaccgaacggggtaaccaagctacggagacgtacgaaaacgaacgtgaacgctacgacaacctactctagttcc

SEQ ID NO: 357552 - DNA, 533 bp, Homo sapiens
  misc_feature: GZ8MTXP02F4CD4.51.79.H02.1.454.CMB.2.raw
  modified_base (253)..(253): a, c, t, g, unknown or other
  misc_feature (253)..(253): n is a, c, g, or t
  modified_base (515)..(515): a, c, t, g, unknown or other
  misc_feature (515)..(515): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaaacncctacttgacttggttcagcagaggcctggccaatctccaaggccgtccttatttataaggtttctaagtcgggactttggggtcccagacagacttcagcggcaggtggtcacgcactcaccttcacactagaaaatcagcgagggtggaggcgtggaggtagtttaggggtttattacgtgcagtgacaaggtacacacgtcgcctcgtactacgtttggaccgtagggaccaaggctacgagactacgaaacgactggnggctcgacacgatctgtc

SEQ ID NO: 357553 - DNA, 607 bp, Homo sapiens
  misc_feature: GZ8MTXP02H04B8.51.79.H02.1.454.CMB.2.raw
  modified_base (251)..(251): a, c, t, g, unknown or other
  misc_feature (251)..(251): n is a, c, g, or t
  modified_base (364)..(364): a, c, t, g, unknown or other
  misc_feature (364)..(364): n is a, c, g, or t
  modified_base (411)..(411): a, c, t, g, unknown or other
  misc_feature (411)..(411): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctcctccctgcccgtcaccttggacaggcgcctcatctcctgcaggtctagtcacacgcctctacacagtgataggaaacncctatgacttggtcagcagacgctggccaatcctacaaggctcttaattagtaagttcaagttcgggtactttggggaccagaacagtacgtcaggcgtacaggtcgggtacncgctaactctacttacacaactaagaaaactcagcgagggtaggagngtagaaggttaagtttaggggtttattacgtagtacgtagtagtacgtaaaggtaccaacgtaacgtcggtacccttacccgtacgttaccgtttacggacccggtaacggggtaaccaaaacggtacgtaacgaacgtaacgtaaaccgaaacgtaacgtggtaacggctacgaccaccgtacgtcttacgttcc

SEQ ID NO: 357554 - DNA, 788 bp, Homo sapiens
  misc_feature: GZ8MTXP02G1GNP.51.79.H02.1.454.CMB.2.raw
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgataggaaacacctacttgacttggttcagcagacggcctggacccaatcctaccgaaaggtccgtacctttaatttaagttaagggttttcctaaaaggttccggggtacgtttttcgggggaccccaaggtaacctaggtaccttccgaaggtccgggacgtaacggttcgggggttaccaccgggtaccctaaccgttcctaaccgtttcccaaaccgttaaaccttaaacgggaaaaaacttccgaaacggtaccggaaagggggttacggggaaggggtaccgttagggggtaaaggggtttaacggtttttaaggggggttttaaatttaaccgttaggtaccgtaaggttacggaccgtaaaacgggttaccaaccgtaaccggttccggtacccgttacccggttaacgttaccggtttttacgggacccggtaaacgggggtaacccaaaacggtccgtacggaaacgaacgttaccgaaaaaccgtacgttagggcggtaccgtacggaccaacccgtattcccttacggtttccc

SEQ ID NO: 357555 - DNA, 515 bp, Homo sapiens
  misc_feature: GZ8MTXP02FQT8P.51.79.H02.1.454.CMB.2.raw
  modified_base (250)..(250): a, c, t, g, unknown or other
  misc_feature (250)..(250): n is a, c, g, or t
  modified_base (293)..(293): a, c, t, g, unknown or other
  misc_feature (293)..(293): n is a, c, g, or t
  modified_base (354)..(354): a, c, t, g, unknown or other
  misc_feature (354)..(354): n is a, c, g, or t
  modified_base (496)..(496): a, c, t, g, unknown or other
  misc_feature (496)..(496): n is a, c, g, or t
tcagcgatcgtatacacgaccggtgctcgatttagtgtcacacgaagggaaaggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctacacagtgatggaaacncctactgacttggttcagcagagcctggccaatctccaaggcncttatttataaggtttctaatcgggactttggggtcccagacagattcagcgcagtggtcncgcactcacttcacactagaaaatcagcagggtggagctgaggtagtttaggggttattacgtgcatgacaaggttacacacgtggcctccgtacacgtttcggccgtaggggaccaagctacgagactacaaacgactagnggctcgacaccatctgttc

SEQ ID NO: 357556 - DNA, 510 bp, Homo sapiens
  misc_feature: GZ8MTXP02GD7FM.51.79.H02.1.454.CMB.2.raw
  modified_base (252)..(252): a, c, t, g, unknown or other
  misc_feature (252)..(252): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctacacagtgataggaaacncctactgacttggttcagcagagctgccatcncagcncttattatagttcaagtcggatttgggccagacagattcagcgacagtcggtcacgcactcacttcaacactagaaaatcagcagggtgagcgtgaaggtagtttagggttattacgtgacagtgacaaggtacacgactggcctacgtactacgtttaggccgagggaccaagcgtacgagactacaaaacgcttgaagtcacgaccactactctattcc

SEQ ID NO: 357557 - DNA, 639 bp, Homo sapiens
  misc_feature: GZ8MTXP02IBN52.51.79.H02.1.454.CMB.2.raw
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacacctactgacttggttcagcagaggcctggccaatcctaccgaacggccgtacctttaatttagttaaagggttttctaaagttcggggtaactttcggggtacccctaagtactagtactttacgaggccggataggtcgggtcaccgtcaactccgtaactttcaactactagaaaactcgaagcgtaggggtacggaggtcgtaggagggttagtttaagggggtttattacgtagtcgtagtcgagtaaaggttacacgtacgtcggtcctaccgtacgttacgtttacggacgtaacggggaccaacgtcgtacgtaacgactaaccgaaaacgtaaccgtggtaacggtcgtacgaccgtaaccgtacttcgttcgttaccc

SEQ ID NO: 357558 - DNA, 661 bp, Homo sapiens
  misc_feature: GZ8MTXP02IXINB.51.79.H02.1.454.CMB.2.raw
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgacctccatctcctgcaggtctagtcacagcctcctacacagtgatacggaaacacctactgtacttggttcagcagacgcctggaccaatcctaccgaacggtccgtacctttaagtttaagttaacggtttactaaacggtcggggtacgtttcggggacccaagtacgtaacgtacttacgaaggtcggacgtagggtcggggttaccacggacctaccttccgtaaccttaccaactaacgtaaacgtaaaactcgaaggcgtaagggggtacggaggtacgtaggtaagggttagttttaaggggttattacgttggactagtacggagtaacggtacgaactacgtcgtacctacggtactacgtttcggaccggtacggggaacacggtacgacggtaactacgtaacgaaaacgtacgtacggtaagacgtacgaccacgtactcgtactttac

SEQ ID NO: 357559 - DNA, 642 bp, Homo sapiens
  misc_feature: GZ8MTXP02G0MFV.51.79.H02.1.454.CMB.2.raw
  modified_base (381)..(381): a, c, t, g, unknown or other
  misc_feature (381)..(381): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcacgtggggatgttgtggtgactcagtctcctctctccctgcccgtcacccttggacaggcgcctcatctcctgcaggtctagtcacagcctctacacagtgataggaaaacctacctacttgacttggttcagcagacggcctggaccaatctaccgaagcgtacctttaatttataaggtttactaagttcgggtacgtttcggggtaccagacagacttcgagcggcgtaggtcggacnccgcactccgacttcaactataagaaaactcgagacgagggtaggacggtagtaggaaggttaaggtttaggggtttacttagtagacgttaagtggtaacgtaacggttacgaactaaccggtcggtacccgttaccgttaacgttaccggtttaccggaccgggacggggtaaacccaaggtccgtacggaacgtaacgtaaccgaaaacggtaacgttcggaaggtcgtacggaccctactacgttcgtcgtttaccg

SEQ ID NO: 357560 - DNA, 667 bp, Homo sapiens
  misc_feature: GZ8MTXP02JC93U.51.79.H02.1.454.CMB.2.raw
  modified_base (257)..(257): a, c, t, g, unknown or other
  misc_feature (257)..(257): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggccggcctccatctcctgcaggtctagtcacagccctcctacacagtgataggaaaaccnccttacttgacttggttcagctagacggcctggaccaatcctaccgaaaggtccgtacctttaatttaagtaaggttttctaaagttcggggtacttttcggggccccaagtacctagtacttcaggcggtactaggttcggggtccacggccaactcctaactttccaactacgtaagaaaactcgaagcgaaggggtggaaggtcgtagggaaggttagttttaagggggttattaacgtggactagtagtacgtaaagggttacactaacgtcggtccctaccggttaacttacggtttcggaccggtaacgggggaaccaaacggtccgtacgaaagtacgtaaccgtaaaacgtacgttacggttaacggacgttacggacccaactacgtacttacgtttaccc

SEQ ID NO: 357561 - DNA, 618 bp, Homo sapiens
  misc_feature: GZ8MTXP02HOD27.51.79.H02.1.454.CMB.2.raw
  modified_base (378)..(378): a, c, t, g, unknown or other
  misc_feature (378)..(378): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcacgtggggatgttgtggtgactcagtctcctctctcctgcccgtcaccttggacaggcgcctcatctctgcaggtctagtcacagcctcctacacagtgataggaaacacctatgacttgtcagcagacgctgaccaatctacgaaggtctacttaattataaggtttctaagtcggtacgttcgggaccagactagacttcgacgtcgacgtaggtcggactacgcactctactcanactagaaaatcgagacgaggggtcggaggtacgtagggtaaggttaaggttttaagggggtttacttacgtagtacgtaagttacggaacgtaaaacgggttaccaacgtaacgttacggtaccccgttaccggttaaccgttaccgttttacgggacccgtaacggggaacctaaacgcgtacgagaactaaccgaaacgtaacgtcgtaaggctacgactaccgtattcgttacgtcc

SEQ ID NO: 357562 - DNA, 593 bp, Homo sapiens
  misc_feature: GZ8MTXP02HNHMU.51.79.H02.1.454.CMB.2.raw
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctcctccctgcccgtcacccttggacaggcggcctccatctcctgcaggtctagtcacagccctcctacacagtgataggaaacacctacttgacttggttcagcagaggcctggccaatctccaaggcgtcctttaatttataaggtttctaagttccgggtacttttggggacccagacagtacttcgagcggctaggtcgggtcacgcactcacttcacgactagaaaatcgagacgaggggtggagctaggtaaggttagttttaggggtttattacgtgacgtagtaggtacgtaaaggtaccacgtacgtcggtaccctaccgttacgtacgtttcggacgtacggggaccagcgtacgaagtactacgaaaacgtaacgtggtaacggactacggacctactacgtcttacgttcc

SEQ ID NO: 357563 - DNA, 556 bp, Homo sapiens
  misc_feature: GZ8MTXP02HID3R.51.79.H02.1.454.CMB.2.raw
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgataggaaacacctacttgacttggttcagcagagcctggccaatcncaaggcncttattataagttctaagtcggatttggggcccagacagacttcgagcggcaggtcgggtcacgcaactcacttcaacactagaaaatcagacgagggtaggaggctggaaggtagtttaggggtttatacgtgctatgactaaggacacacgtcggacctacgtacgtacgtttagggaccgtaacggggaccaaggcctaggacgtaacgtaccgaaaacgacttaggcggcgttacgaccacctagtcctcgttacc

SEQ ID NO: 357564 - DNA, 568 bp, Homo sapiens
  misc_feature: GZ8MTXP02JREMB.51.79.H02.1.454.CMB.2.raw
  modified_base (253)..(253): a, c, t, g, unknown or other
  misc_feature (253)..(253): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatcctcctgcaggtctagtcacagcctcctacacagtgatggaaaacncctacttgacttggttcagcagaggcctggccaatctccaaggcaccttattagtaaggtttctaagtcgggtactttggggtacccagacagacttcgagcgcaggtcggtcacgcactacacttcacactagaaaatcagcgagggtgagctggaggtagtttagggttatactgctaatgacgtaaagggtaccaacgaccgttaggacccttacgtacttacgtttcggaccgaacggggtaccaagccgtacggaagtacgaccgtaaaacgactaggtaacgctacggacaaccgtattctcgtttacc

SEQ ID NO: 357565 - DNA, 633 bp, Homo sapiens
  misc_feature: GZ8MTXP02GE2Z0.51.79.H02.1.454.CMB.2.raw
  modified_base (252)..(252): a, c, t, g, unknown or other
  misc_feature (252)..(252): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacncctatgacttggttcagcagacggcctggaccaatcctaccgaaaggccgtacctttaatttaacgtaacgggttttcctaaaagttccggggtaacgtttttcggggtaccccaaggtaacctaggtaacctttccgaaggcggtactaaggttcggggtaccacggctaaccttaccaaccttcgaacaacttaagaaaaatcgagacgagggtaggaggtctaggtaaggtagtttaggggttatacgtgactagtgactaaggtacacgtacgtcggacctaccgtaactacgtttggacccgaagggaaccacgcgtacgaagtacgtacaaaacgtactaggtaacgctacgacctaccgtattccgtacgttcc

SEQ ID NO: 357566 - DNA, 633 bp, Homo sapiens
  misc_feature: GZ8MTXP02IGZRD.51.79.H02.1.454.CMB.2.raw
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctcctccctgcccgtcacccttggacaggcgcctcatctcctgcaggtctagtcacagcctcctacacagtgataggaaacctaccttacttgtactttggttcagcaggacggcctggacccaatcctaccgaaggtccgtacctttaatttagttaacggtttactaacgttcggggttacgtttcggggtaccctagtacagtacttcgagtcggacgtaggtcggggtaccacggtcctactacctaccttccaacgtactaagaaaactcgagacgtagggggtaggaggcgtaggtaaggttaggttttaggggttacttacgtgtactagtcggacgtaaggtacacgtacgtcgacctacgtacgtacgtttcggaccgtacgggtaaccaagcgtacggaacgaactaccgaaacgtacgtaggtcgtctacgaccacctacttacgtcttacc

SEQ ID NO: 357567 - DNA, 707 bp, Homo sapiens
  misc_feature: GZ8MTXP02FYAGD.51.79.H02.1.454.CMB.2.raw
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgccaggtctagtcacagcctcctancagtgatggaaacnctatgacttggttcagcagacggcctggccaatcctacaaggtcctactttaatttagtaaggttttacaagttccgggtaacttttcggggccccagtacagtaccttcgaggtcgcgaggtcggtcacgtcacgtactaccttcaactaaactagaaaaacttcgaacggtcgaaagggggttcggaacgggtacttaggggtaacggggttaagtttttaacgggggtttaaacttaccgtaggtacgtacgttacggacgtaaaacgggttaccaaaccggtacccgttggggtacccccttaacggttaacccgttaacgttttaccggggacccggttaacgggggaaaccctaacggtccgttaaccgggaaacgtaacttaccggaaaaacccgtagtttacgggcggttacgtacggaccctaacctaggttccttcggtttaaccc

SEQ ID NO: 357568 - DNA, 567 bp, Homo sapiens
  misc_feature: GZ8MTXP02JBUEE.51.79.H02.1.454.CMB.2.raw
  modified_base (253)..(253): a, c, t, g, unknown or other
  misc_feature (253)..(253): n is a, c, g, or t
tcagcgatcgtatacacgaccggtgctcgatttagtgtcacacgaaggcaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggccggcctccatctcctgcaggtctagtcacagcctcctacacagtgatggaaacncctatgacttggttcagcagaggcctggccaatcctccaaggcgtacctttatttataaggtttctaaagtcgggtactttggggtcccagacagattcgagcgcaggtggtcacgcactcacttacacactagaaatcagcgagggtgagctggagttagttaggggttatacgtgacagtgacgaaggtaccacgactcggacctcgtactacgtttcggacccgtaacggggaccaggccgtacggaacgtacttaaccgaaaacgtaacgtcgggtacgacgttacggacctacccgtaacttcgttacg

SEQ ID NO: 357569 - DNA, 617 bp, Homo sapiens
  misc_feature: GZ8MTXP02HM9IB.51.79.H02.1.454.CMB.2.raw
tcagcgatcgtatacacgaccggtgctcgatttagtgtcacacgaagggaaagggggatcaggactcctcagttcaccctctcacaatgaggctccctgctcagctcctggggctgctaatgctctgggtcccaggatgcactggggatgttgtggtgactcagtctcctctctccctcgcccgtcacccttggacaggcgcctccatctcctgcaggtctagtcacagcctcctacacagtgaatagaaaccacctacttgtacttggttcagcagacggcctggaccaatcctaccgaaggcgtacctttaatttaagtaaggtttactaagttcgggtacgtttcggggccagactagtacttcgaagcggcgaggttcgggacacgctactacctaccttaccaacaacttaagaaaactcgaacgacgaggggtaggaggtcgtaggtaaggttaggtttacggggtttattacgtaggtactagttagacgtaacgtaacaacgtacgtcggacctaccgttacttacgtttacggaccgaacgggtacaacgcgtacgaagtactacgaaacgtaacgtgtaacggctacgacactactcttacgttacg

SEQ ID NO: 357570 - DNA, 619 bp, Homo sapiens
  misc_feature: GZ8MTXP02J0EL4.51.79.H02.1.454.CMB.2.raw
  modified_base (390)..(390): a, c, t, g, unknown or other
  misc_feature (390)..(390): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcacgtggggatgttgtggtgactcagtctcctctctccctgcccgtcacccttggacaggccgcctccatctcctgcaggtctagtcacacgccctacctacacagtgataggaaactcctattgacttggttacagcagacggcctaggacctaatcctaccgaaggtcctactttatttaagtaacggtttctaagtcggtacgtttcggggacccagactagtacttcgaggcggactaggtcggtcncgctacgtcacttacactactagaaactcagacgagggtggagcgtaggtaggttaagtttagggttacttacgtacgtacgtagtacgagtaacgtacgaacgtacgtacggtacccgttaccgtactacgtttacggacggtacgggaccgtacgtaccgtacgaacgtacgtaacgaaaacgtacgtagtaacgtacgtacgacctaccgtacgtcctacgtttcc

SEQ ID NO: 357571 - DNA, 601 bp, Homo sapiens
  misc_feature: GZ8MTXP02JM3SI.51.79.H02.1.454.CMB.2.raw
  modified_base (256)..(256): a, c, t, g, unknown or other
  misc_feature (256)..(256): n is a, c, g, or t
  modified_base (429)..(429): a, c, t, g, unknown or other
  misc_feature (429)..(429): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcacgtggggatgttgtggtgactcagtctcctctcctccctgcccgtcacccttggacaggcgcctcatctcctgcaggtctagtcacagccctacacacagtagatacggaaaacncctatgtacttaggttcagcaggagcctggaccaatctacaaggctaccttatttagtagtttactaagttcgggtacgtttcggggtacccagactagtacttcgagcggtacgaggtgggtcaccggcacctctacttacaactactagaaaatcagcgaggggtgaaggngtaggtaggttacgtttagggttatacgtagacgtagtagtacgtaagtacctaacgtacgtaccggtacccttacgttacgttaccgtttacgggacggaacggaaacgtacgtacgtacgtacgtaacgtaacgaaacgtacgtacgtaagctacgacactactctagtc

SEQ ID NO: 357572 - DNA, 608 bp, Homo sapiens
  misc_feature: GZ8MTXP02JN617.51.79.H02.1.454.CMB.2.raw
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
  modified_base (392)..(392): a, c, t, g, unknown or other
  misc_feature (392)..(392): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcacgtggggatgttgtggtgactcagtctcctctctccctgcccgtcaccttggacaggcgcctcatctcctgctaggtntagtcacacgcctcctanacagtgataggaactacctacttgacttggttacagactagacggtcctaggaccaatcctaccgaagtcctactttattaataacggtttctaagtcgggtacgtttacggggacccaaggactagtacgtacgagcgtacgtaggtcggtacncgacacttcactcactactagaaactcgagacggagggtaggaggtcgtaggtaggttaggtttaaggggttactacgtagactagtacggataacggtacagtaccgtcggtacccttaccgtacgttacgttcgggaccgtaacggtaccaacgccgtagacgtacgacgaaactacgtcgaacggactacgacctacgtactcgtcgtttacc

SEQ ID NO: 357573 - DNA, 656 bp, Homo sapiens
  misc_feature: GZ8MTXP02FNJM1.51.79.H02.1.454.CMB.2.raw
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcacgtggggatgttgtggtgactcagtctcctctctccctgcccgtcacccttggacaggcgcctcatctctgcaggtctagtcacagcctactacacagtnataggaaacncctatgacttggttcagcagacgcctggaccaatcctacgaaggctacctttatttaataacggtttctaacgtcgggtacgttttcggggcccagtacagatttcgaggtcggactaggtcgggtacacggctacgtcacttcaactactagaaaatcagacgagggtaggacggtgtggaaggttagtttaggggttaacttacgtagacgtagtagacgtaaacggtactaacgacgtcgtaccgttaccgttaaccgttaaccgttttcgggaccccgaaacgggggtaacccaacggtaccggttacgaacggtaaacgttaaccgaaaaccggtaaaccgttggtaacgggtacccttacggaccctaacccttaacggttaccgttcgttttaacccg

SEQ ID NO: 357574 - DNA, 668 bp, Homo sapiens
  misc_feature: GZ8MTXP02G1G2W.51.79.H02.1.454.CMB.2.raw
tcagcgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctctctctccctgcccgtcaccttggacaggcggcctcatctcctgcaggttctaagtcacagtcctcctaacgacagtgataggaaaacctaccgtacttgacttggttcaagcagacggtcctggaccaaatcctaccgaaaggtccgtaccttttaagtttaaagttaagggtttacctaaagttccggggtaacgttttcgggggtaccccagtagacgtaagtttccgaagtcggacgtaggtcggggtcaccgtacactcgtaccttcaacgtactaagaaaactcagacgagggagtaggactgaaggtagtttaaggggttattaacgtagctaagtacgtagaaagtaccgacgaaacctgggtaccctacgtaactaccgtttagggccgaaacggggtaaccaacgaccggttacgaaacggtaactaacgaaaaccgtaaacgtaccgtaagggacccttaggaccaaccgtaacgttcctaggtttaccg

SEQ ID NO: 357575 - DNA, 511 bp, Homo sapiens
  misc_feature: GZ8MTXP01C2FYB.10.44.D11.1.454.CMB.2.raw
  modified_base (200)..(200): a, c, t, g, unknown or other
  misc_feature (200)..(200): n is a, c, g, or t
  modified_base (302)..(302): a, c, t, g, unknown or other
  misc_feature (302)..(302): n is a, c, g, or t
  modified_base (369)..(369): a, c, t, g, unknown or other
  misc_feature (369)..(369): n is a, c, g, or t
  modified_base (471)..(471): a, c, t, g, unknown or other
  misc_feature (471)..(471): n is a, c, g, or t
  modified_base (496)..(496): a, c, t, g, unknown or other
  misc_feature (496)..(496): n is a, c, g, or t
  modified_base (507)..(507): a, c, t, g, unknown or other
  misc_feature (507)..(507): n is a, c, g, or t
tcagcatagtagtgcacgaccggtgctcgatttagcgcagtacgaaggggaggaactgctcagttaggacccagagggaaccatggaagccccagctcagcttctcttcctcctgctactctggctcccagtttcagataccaccggagagattgtgttgacacagtctccagccaccctgtctttgtctccaggggaangccacctctcctgcagggccagtcagagtgtgcgcctagtagcctggtaccaacagaaacctggccaggctcccaggcccctcatctatggtgcatccaacnggggccactggcatcccagccaggttcagtggccaggtgggtctggggacaggacttcactctcacntcatcagctggagcctgaagatgttgctagtttatactgtcaactatcgtaccgagtcggccgtccgggggcctacgttccggccctgggaccaaaggtganatcaaacgaactgttgcttgcaccntctgttcttcnttcc

SEQ ID NO: 357576 - DNA, 735 bp, Homo sapiens
  misc_feature: GZ8MTXP01BIMP6.10.44.D11.1.454.CMB.2.raw
  modified_base (282)..(282): a, c, t, g, unknown or other
  misc_feature (282)..(282): n is a, c, g, or t
  modified_base (319)..(319): a, c, t, g, unknown or other
  misc_feature (319)..(319): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggagtcacagagactctcctgtgcagcctcgtgggttcaccttcagtacgctacggnatgcacgtcgggcccacaagcctccgaggcgaagggnttgggagtgggtgctagtttgttcatcgtggacgggctagtgttacaagttgggtaatcggacaacggtaccgtccgggtaaggaaacggggtccctattaccaacctactacctaccgaagaacgaaacctaaacgttacccgaaaggaaaccaaacgtaaagttagttaaagtttaagggggtaaaaattaggaaaacctaacggtaaccgtaaacggtccgttaagggaaacgggtaacgtaaccgggggttagttaaacgttaaccgttaaacggttaagggttaaaccggggaaaagggggaaacggggggaaacccgtaaggggttacggggttaacgttacccgtaaaggttccgttaaccgtttagggtacccggttacgggtccgggggttaacccggtaaccgggg

SEQ ID NO: 357577 - DNA, 598 bp, Homo sapiens
  misc_feature: GZ8MTXP01EUYWY.10.44.D11.1.454.CMB.2.raw
  modified_base (273)..(273): a, c, t, g, unknown or other
  misc_feature (273)..(273): n is a, c, g, or t
  modified_base (295)..(295): a, c, t, g, unknown or other
  misc_feature (295)..(295): n is a, c, g, or t
  modified_base (317)..(317): a, c, t, g, unknown or other
  misc_feature (317)..(317): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagcctgggagtcacagagactctcctgtgcagcctcgtgggttcaccttcagtanctacggcatgcacgtgggtccnccaagcctccgaggcaaggggnttggaggtgggggtggctaggtttgtttcagtcgtggacgggcaggtgttacaagtgggtatgcagactcgtaggaacgggccattcacatctcagagacattaccagaacacaatagtaatttaggggaaatagaacagactaagtccgtaggacggacgtacgggtagtataacgtaacgtaggttaacggaacggggacgggggaaccgagggacggggttacgttaccgtaaggtaccgttccgttcggacggttcgtcggggttccgtaaccgggg

SEQ ID NO: 357578 - DNA, 531 bp, Homo sapiens
  misc_feature: GZ8MTXP01AIJLE.10.44.D11.1.454.CMB.2.raw
  modified_base (201)..(201): a, c, t, g, unknown or other
  misc_feature (201)..(201): n is a, c, g, or t
  modified_base (286)..(286): a, c, t, g, unknown or other
  misc_feature (286)..(286): n is a, c, g, or t
  modified_base (375)..(375): a, c, t, g, unknown or other
  misc_feature (375)..(375): n is a, c, g, or t
tcagcatagtagtgcacgaccggtgctcgatttagcgcagtacgaaggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccacctctcctgcagggccagtcagagtgttggcgcctagtagcctggtaccaacagaacctggccaggctcccaggccccctnatctatggtgcatcccaacaggggccacgtggcatcccagccaggttcagtggccaggtggtctggggacaagaccttcactctcaccntcatcagcctggacgcctgaagtatgtgctagttattactgtacaacgtatcgtaccgagtcggccgtccggggcctacgttcggccctgggaccaaggtggattagtacaaacgtactgttcgcttcgcacgaactctgttccttcaacgttccc

SEQ ID NO: 357579 - DNA, 646 bp, Homo sapiens
  misc_feature: GZ8MTXP01DJQ5Y.10.44.D11.1.454.CMB.2.raw
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (325)..(325): a, c, t, g, unknown or other
  misc_feature (325)..(325): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagcctgggagtcacagagactctcctgtgcagcctntgggtcaccttnagtanctacggcatgcacgtcgggtcccaccaagcctacccgaaggacaaagggggtntttgggaggttggggtgctaggtttgtttcagttcgtggacggggctaggtgttacaagtgggtatggacagtacgtccggtaggaaacgggcctattaccacatcacagaagaacaactaccaagaaacacaatagttaattaggggaaaatagaaacagtacctaaagtccgtagaacggtacgaacgggttataactacgtaacgtacgggttaaacggaaaggggacgggggaaacccgagggaccgggttacgttacccgtaaaggttaccctccggttttcggaaccggttcggtcggggttcccgtaaccgggg

SEQ ID NO: 357580 - DNA, 568 bp, Homo sapiens
  misc_feature: GZ8MTXP01DY3GW.10.44.D11.1.454.CMB.2.raw
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
  modified_base (372)..(372): a, c, t, g, unknown or other
  misc_feature (372)..(372): n is a, c, g, or t
  modified_base (387)..(387): a, c, t, g, unknown or other
  misc_feature (387)..(387): n is a, c, g, or t
  modified_base (403)..(403): a, c, t, g, unknown or other
  misc_feature (403)..(403): n is a, c, g, or t
  modified_base (451)..(451): a, c, t, g, unknown or other
  misc_feature (451)..(451): n is a, c, g, or t
tcagcatagtagtgcacgaccggtgctcgatttagcgcagtacgaaggggggagaggagcccagcactagaagtcggcgttgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggagtcacagagactctctgtgcagcctctgggttcaccttcagtagctacggcatgcacgtgggtcccncaagctccgaggcaagggnttggagtgggtgctagtttgttcagtctgacgggcagtgttcaatggtatgcagactcgngaaggcatcacatcncagagacatcagacanaatgtattagggaaatgaacagctaagtccaggaacggactacgggtntaactacgtaacgtggttaacgggaaagggttacgggggaaaccgagggacgggttcgttaccgaagttaaccgttcccgtttggaccgttcggtcgggggttccgtaacccggggg

SEQ ID NO: 357581 - DNA, 667 bp, Homo sapiens
  misc_feature: GZ8MTXP01BH7HH.10.44.D11.1.454.CMB.2.raw
  modified_base (297)..(297): a, c, t, g, unknown or other
  misc_feature (297)..(297): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacagagactctcctgtgcagcctcgtgggttcaccttcagtagctacggcatgcacgtgggtcccnccaagcctccgaggcaaggggattgggaggtggggtggctaggtttgtttcatcgtggacgggctaggttgttacaagttgggtaatgactaaggtacctccggtagggaaacggggccctaagttaccaccattcctaccgaagacgaactaacttaccgaaggaaaccaacgtaaattagttaaagtttagggggaaaacttacggaaacacgtacctaaacgtcccgtaggaacgggacgtacggggttataacgtacgttaacgtagggttaacgggaaaggggacgggggtaaaccagggaccgggttagttaccgaacgttaccgttccgtttaggaccgttcggtcggggcccgtaaccgggg

SEQ ID NO: 357582 - DNA, 580 bp, Homo sapiens
  misc_feature: GZ8MTXP01A6D2D.10.44.D11.1.454.CMB.2.raw
  modified_base (293)..(293): a, c, t, g, unknown or other
  misc_feature (293)..(293): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctctggggttcaccttcagtagctacggcatgcacgtgggtccnccaagcctccgaggcaaggggattgggaggtggggtggctaggtttgtttcagtcgtggacgggctaggttgttacaagtgggtatgcagactccgtggaacgggccatcacatctcagagacatacagaacacaatagtattagggaaatagaacagacctaagtctagacggacgtacgggtatactactaacgtgttaacgggaagggacgggggaaccgagggacggggacgttaccgaagtccgtccgttaggacggttcggtcggggttccgtaaccgggg

SEQ ID NO: 357583 - DNA, 537 bp, Homo sapiens
  misc_feature: GZ8MTXP01E2G2U.10.44.D11.1.454.CMB.2.raw
  modified_base (202)..(202): a, c, t, g, unknown or other
  misc_feature (202)..(202): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (385)..(385): a, c, t, g, unknown or other
  misc_feature (385)..(385): n is a, c, g, or t
  modified_base (531)..(531): a, c, t, g, unknown or other
  misc_feature (531)..(531): n is a, c, g, or t
tcagcatagtagtgcacgaccggtgctcgatttagcgcagtacgaaggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagagtgttggcgcctagtagcctggtaccaacagaaactggccaggctcccaggcccctnatctatggtncatccaacngggccacgtggcatcccagccaggttcaggtgccaggtggtctggggacaagcttcactctcacatcatcagctggacnctagaagtatgttgactagttattactgtacaactatcgtacgagtcggccgtccgggggcctacgttccggcccgttggaaccaaaggtggaattacgtacaaacgtacgtgttcggcttcgcacctaatctgttcttaacgttntttccc

SEQ ID NO: 357584 - DNA, 548 bp, Homo sapiens
  misc_feature: GZ8MTXP01AM985.10.44.D11.1.454.CMB.2.raw
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
  modified_base (393)..(393): a, c, t, g, unknown or other
  misc_feature (393)..(393): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggagtcacagagactctcctgtgcagcctctgggttcaccttcagtagctacggcatgcacgtgggtccnccaagcctccaggcaagggnttggagtggggtgctaggtttgttcatctggaggcagtgtcaagtgggtatgcagactccgtagaagggccatcacatcncagagacatacagaacacaatagtattaggggaaatagaacagtacctaagtcctagacggacgtacgggtgtaatactaacgtaggttacggaagggagggggaacgaggcgggagttacgaagtctcgttgacgttcgtcgggccgtaacggg

SEQ ID NO: 357585 - DNA, 662 bp, Homo sapiens
  misc_feature: GZ8MTXP01BYT0G.10.44.D11.1.454.CMB.2.raw
  modified_base (296)..(296): a, c, t, g, unknown or other
  misc_feature (296)..(296): n is a, c, g, or t
  modified_base (318)..(318): a, c, t, g, unknown or other
  misc_feature (318)..(318): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggagcgtggtccagccgtgggagtcacagagactctcctgtgcagcctcgtgggtcaccttcagtagctacggcatgcacgtcgggtccncaagctccgaggcgaaggggtnttgggaggtgggggtggctaggtttgtttcagtcgtggacgggtctaggttgttacaagttgggtatggacagtaccgtccggtaggaacggggcctaattccacctactctacagaagaactaacgttaccgaaggaacactaattagttaagtttaggggaaatagaaacaacgtacctaaagtccgtaggaacggtacgtacgggtagttaacgtacgttaacgtagggttaaacgggaaagggggaacgggggaaaccgacgggacggggttacgttacccgtaaagttaccgttccgtttcggaccgggttcggtccgggggttaacccgtaaccgggg

SEQ ID NO: 357586 - DNA, 561 bp, Homo sapiens
  misc_feature: GZ8MTXP01B2PZ6.10.44.D11.1.454.CMB.2.raw
  modified_base (291)..(291): a, c, t, g, unknown or other
  misc_feature (291)..(291): n is a, c, g, or t
  modified_base (465)..(465): a, c, t, g, unknown or other
  misc_feature (465)..(465): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggagcgtggtccagcctgggagtcacagagactctcctgtgcagcctctgggttcaccttcagtagctacggcatgcacgtgggtccncaagctccgaggcaaggggattggagtggggtgctaggtttgtttcatcgtgacggggcagtgttcaagtggtatgcagactcgtagaacgggctattcacatctcagagacattcaggaacacaatgtattaggggaaatgaacacgactaagtccgtgacgacgtacgggtntatactaacgtggttacggaagggagggggaaccgagggacgggttacgttaccgaagtaccttccgttggacggttcgtcggggccgtaacgggg

SEQ ID NO: 357587 - DNA, 702 bp, Homo sapiens
  misc_feature: GZ8MTXP01DDE3P.10.44.D11.1.454.CMB.2.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (297)..(297): a, c, t, g, unknown or other
  misc_feature (297)..(297): n is a, c, g, or t
tcagcatagtagtgcacgaccggtgctcgatttagcgcagtacgaaggggaggaactgctcagttaggacccagagggaaccatggaagccccagctcagcttctcttcctcctgctactctggctcccagtttcagataccaccggagagattgtgttgacacagtctccagccacccttgttctttgtctccgaggggaaangccaccctctccngcagggccagtcagagtgttggcgcctagtagcctaggtaaccaagacgaaacctggccaggcctcccgacggccccctnatctagtggtgaccatcccaaagcgggacccacgtggccactcccagcctaggttcaggtcggccaggttcgggtcgtaggggacctaaggtacctttccgaactccctaacaccctattccatcgacgtccgtaggacgcctaggaaagtgttagttgacgttagtttacttacgtagttacctaaacgtacgttccggtaaccggcggttcgggccccggttcccgggggacccttaaccggtttcccggggtaccccgttaacggggaacccgtaaagggtaacgtaaacgttacgtaaacccgaaaacggtaaacccgttgggttaaccggttccgttacggaacccgtaaaccccgttcgtttccgttccgtttacctttaaccgttaaccgtttccccg

SEQ ID NO: 357588 - DNA, 561 bp, Homo sapiens
  misc_feature: GZ8MTXP01D5Q6V.10.44.D11.1.454.CMB.2.raw
  modified_base (291)..(291): a, c, t, g, unknown or other
  misc_feature (291)..(291): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggtttcctcgttgctcttttaagaggtgtccagtgtcaagtgcaactggtggagtcgtgggggagcgtggtccagcctgggagtcacagagactctcctgtgcagcctctgggttcaccttcagtagctacggcatgcactgggtcccnccaagctccaggcaaggggattggagtggggtgcagtttgttcatcgtgagggcagtgttcaagtggtatgcagactcgtagaacgggccattcacatctcagagaacaattccaaggaacacaatagtattaggggaaatagaaacagcctaaagtcctgaaggactacgggtgtaatactaacgtgttacggaaagggagggggaaaccgagggacggggacgttaccgaagttactccgtttggacgttcgtcggggccgtaacggg

SEQ ID NO: 357589 - DNA, 547 bp, Homo sapiens
  misc_feature: GZ8MTXP01E2NA3.10.44.D11.1.454.CMB.2.raw
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctggggagtcacagagactctcctgtgcagcctctgggttcaccttcagtagctacggcatgcacgtgggtccncaagctccaggcaaggggnttgggagtgggtgctagtttgttcatctggagggcagtgttcaatggtatgcagactcgtagaagggcatcacatctcagagacaattccaagaacacaatagtattaggggaaatgaacagacctaagtcctagacggacgtacgggtagtatactaacgtgttacggaagggacgggggaaccgaggcgggagttaccgaagtactcgttgacgttcgtcgggccgtaacggg

SEQ ID NO: 357590 - DNA, 753 bp, Homo sapiens
  misc_feature: GZ8MTXP01A1VUJ.10.44.D11.1.454.CMB.2.raw
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctctgggttcaccttcagtagctacggcatgcacgtcgggtccgccaagcctaccgaggcaaggggattgggaggtgggggtggctaggtttgtttacagttcgtggacggggctaggtgttacaagtgggtatggcaggacttccggtaggaaacggggtccgtattccgacctatcctaccgaagaacgaactaacgttacccgaaaggaaaccaacgtaaagttagttaaacgtttaacgggggtaaaagttacggaaaaccgtaacggtacccgttaaagttccgtttaagggaaacgggtaaccgtaagggggttacgttaaacgttaacccgttaacggttaacgggttaaaccggggtaaaaggggggaaacgggggggtaaaaccccggagggggttaaccgggggttaacggtttaacccggtaaacgggtttacccgttcccggttttacggggaccggttaccgggtcggggggttaacccgttaaccggggg

SEQ ID NO: 357591 - DNA, 832 bp, Homo sapiens
  misc_feature: GZ8MTXP01AP4QU.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggagtcacagagactctcctgtgcagcctcttgggttcaccttcagtacgctacggcatgcacgtcgggcccaccaagcctaccgaggcgaaggggtattgggaggttggggtggcttaggtttgtttacagttcgtggacgggtctaggttgttcaaagttgggtaatggactaacggtacccgttccggggtaggaaacgggggcccctaaatttcccaacccgtaacttcccgtaccgaaggtaacgtaaacctaaaccgttacccgaaacgggtaaaccaaacgtaaagttacgtttaaacgttttaagggggaaaacgttaacggaaaaccgtaacggtaacccgttaaaacggttcccgtaaagggtaaccgggtaaccgtaaccgggggtttaattaaacgttaaccggttaaaccggttaaggggttaaaccgggggaaaacggggggttaaacggggggtaaaacccggaacgggggttacccgggggttaaaccgtttaaaccccggtaaacggggtttaccccgtttcccgggttttaacggggtaacccgggtttcccgggtaaccggggggttaaccccggtttaaacccggggg

SEQ ID NO: 357592 - DNA, 596 bp, Homo sapiens
  misc_feature: GZ8MTXP01DCFU0.10.44.D11.1.454.CMB.2.raw
  modified_base (294)..(294): a, c, t, g, unknown or other
  misc_feature (294)..(294): n is a, c, g, or t
  modified_base (543)..(543): a, c, t, g, unknown or other
  misc_feature (543)..(543): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggagtcacagagactctcctgtgcagcctctgggttcaccttcagtagctacggcatgcacgtgggtcccncaagctccaggcaagggattggagtgggtgcagtttgttcatctggacgggctaggtgttacaagtgggtatgcagactcgtagaacgggccattcacatctccagagaacaacttaccaaggaacaacgtaaattagttaagtttagggggaaaattagaaacctacgacctaaagtccctaggaacggacgtaacggggtgtaactaactaacgtaggttaacgggaaaggggacgggggaaaccgngggacgggacgttaccgaagtactccgttgacgttcgtcggggcgtaaccggg

SEQ ID NO: 357593 - DNA, 786 bp, Homo sapiens
  misc_feature: GZ8MTXP01AZPPD.10.44.D11.1.454.CMB.2.raw
  modified_base (301)..(301): a, c, t, g, unknown or other
  misc_feature (301)..(301): n is a, c, g, or t
  modified_base (325)..(325): a, c, t, g, unknown or other
  misc_feature (325)..(325): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggaggcgtggtccagccgtgggaggtcacagagactctcctgtgcagcctcgtgggttccaccttcagtagctacggcatgcacgtcgggtcccnccaagcctccgaggcgaaggggtnttgggaggtggggtggctaggtttgtttcagttcgtggagggtctaggttgttacaaagttgggtatcgacgtaaacgggtacccgttacccgggtaggggaaacggggtcccgtaaactttaccccaacccgtacttacccgtaccccgaaagaaacggtaaaccctaaacgtttacccgaaacgggaaaaccaacgtaaagttagttaaagttttaacgggggaaaattacggaaaccgtaaacggtaacccgttaaacgtacccgttagggaaacgggtaaccggtaacgggggttattaacgttaaccgtaacgttacgggttaaaccggggaaagggggaacggggggaaacccgtaacggggttaccggggttaacgttacccggtaaacggttaccgtttaaccgtttcgggtaccggttccgggtaaccgggggttaacccgtaacccggggg

SEQ ID NO: 357594 - DNA, 731 bp, Homo sapiens
  misc_feature: GZ8MTXP01BXJUY.10.44.D11.1.454.CMB.2.raw
  modified_base (170)..(170): a, c, t, g, unknown or other
  misc_feature (170)..(170): n is a, c, g, or t
  modified_base (303)..(303): a, c, t, g, unknown or other
  misc_feature (303)..(303): n is a, c, g, or t
  modified_base (324)..(324): a, c, t, g, unknown or other
  misc_feature (324)..(324): n is a, c, g, or t
  modified_base (356)..(356): a, c, t, g, unknown or other
  misc_feature (356)..(356): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgcttcttttaagnggtgtccagtgtcaagtgcaacgtggtggagtcggtgggggaggcgtggtccagccgtgggagtcacagagactctcctgtgcagcctcgtggtccaccttcagtacgctacggcatgccacgtcgggtcccncaagcctcgaggcgaagggtnttggaggtgggtgcgtagtttgttcagttcgnggacggctagttcgtacaagttgggtaatcgacgaacgtaccgtaccgggtaggaaaccggggtccctaatttcccaaccgtactacccgtacccgaaaggtaacgtaaaccgtaaacgttaccgaaacgggtaaacctaaacgttaaagtttaacggttaaagttttaaggggaaaaacgtttacggaaaaccgtaacgtaaccgtaaacggtccgtaaggtaaaccggacgtaacgggttagttaacgtaacgtaacggtaacgggttaaccgggaaaggggaacgggggaaaccgtagggaccgggttacgttaaccgtaagttaccgttccgtttacggacggttacgggtcgggaacccgttaaccgggg

SEQ ID NO: 357595 - DNA, 724 bp, Homo sapiens
  misc_feature: GZ8MTXP01BLZ64.10.44.D11.1.454.CMB.2.raw
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
  modified_base (321)..(321): a, c, t, g, unknown or other
  misc_feature (321)..(321): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagccgtgggagtcacagagactctcctgtgcagcctcgtgggttcaccttcagtanctacggnagtgcacgtcgggtcccacaagcctccgaggcaaggggtnttgggaggtggggtggctaggtttgttcagtcgtggacgggctaggttgttacaagttgggtatcggactaaggtacccgtccgggtagggaaacgggggtccctaaattccaaccgtaactccgtacccgaagtaacgtaaaccgtaaacttacccgaaacgggaaacctaacgtaaagttaggtttaagttttaaagggggaaaattacggaaacctacggtaacccgttaaacggtccgtaggtaaacgggtaaccgtaccggggttagttaacgtaaccgttaacggtacgggttaaacggggaaaggggacgggggaaaccgaggggttaccgggttagttacccgaaggttaccttccgtttaggacggttccggtcgggggttcccgtaaccgggg

SEQ ID NO: 357596 - DNA, 549 bp, Homo sapiens
  misc_feature: GZ8MTXP01ERBNG.10.44.D11.1.454.CMB.2.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (529)..(529): a, c, t, g, unknown or other
  misc_feature (529)..(529): n is a, c, g, or t
tcagcatagtagtgcacgaccggtgctcgatttagcgcagtacgaaggggaggaactgctcagttaggacccagagggaaccatggaagccccagctcagcttctcttcctcctgctactctggctcccagtttcagataccacggagagattgtgttgacacagtctccagccaccctgtctttgctccgaggggaaangccacctctcctgcagggccagtcagagtgttggcncctagtagcctggtaccaacagaaacctggccaggcctcccgacggccccctnatctatgggtncatcccaagacggggccaacgtggcactccccagcctaggttcaggtcggcctagggttggggtctaggggactaaggaccttcgactctacaccatcatcacgctggacgctagaagtattgttgactagtttacttacgtgtacaacgtatcgtacgagtcggccgtccgggctacgttcgccgtaggaccaaggtgattagtacaaacgtagtgcgcttcgcactntctgttcttcgttcgttccc

SEQ ID NO: 357597 - DNA, 658 bp, Homo sapiens
  misc_feature: GZ8MTXP01CCLZP.10.44.D11.1.454.CMB.2.raw
  modified_base (298)..(298): a, c, t, g, unknown or other
  misc_feature (298)..(298): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggaggcgtggtccagccgtgggagtcacagagactctcctgtgcagcctctgggttcaccttcagtagctacggcatcgcacgtgggtcccnccaagcctccgaggcaagggattggagtggggtggctaggtttgtttcattcgtggacgggctaggttgtacaagtgggtatgcagactcgagaacgggcatcacatctaccgagacgaactaacttacgaaggaaacactaattagttaagtttaggggaaattagaaaccgtacgtacctaaagtcccgtaggaacggaccgtaacgggtagtaacgtaacgtaacgtacgggttaaacgggaaacggggaacgggggtaaaccgcggggttaccggggttacgttacccgtaaaggttacccgttaaccgtttacggaccggttcggtaaccgggggttaacccggttaacccgggg

SEQ ID NO: 357598 - DNA, 762 bp, Homo sapiens
  misc_feature: GZ8MTXP01CBLWP.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggaggcgtggtccagcctgggagtcacagagactctcctgtcgcagcctcgtgggttcaccttcagtacgctacggcatgcacgtcgggtcccaccaagcctaccgaggcgaaaggggtattgggaggttgggggtcggactaggtttcgtttacagttcgtgggaacggggctaggttgttacaaagttcggtaatggactaacgggtaccttacccgggtagggaaacgggggtccctaatttacccaaccctaacgttacccgtacccgaaaggtaacgtaaacctaaacgttaccccgaaagggaaacctaacgtaaaagttagtttaaacgtttaaagggggaaaattacggaaaactaacggtacctaaacggtcccgttaaggaaacggtaacgtaaccgggttattaacgtaaccgtaacggtacggttaaacgggaaacggggaaacggggggtaaaccgacggggttaccgggttacgtttacccgaaggttaaccgttccgtttacggacggttaccggtaacggggttcccgttaacccgggg

SEQ ID NO: 357599 - DNA, 741 bp, Homo sapiens
  misc_feature: GZ8MTXP01B4C7X.10.44.D11.1.454.CMB.2.raw
  modified_base (247)..(247): a, c, t, g, unknown or other
  misc_feature (247)..(247): n is a, c, g, or t
  modified_base (295)..(295): a, c, t, g, unknown or other
  misc_feature (295)..(295): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagagtgtccagtgtcaagtgcaactggtggagtcgtgggggaggcgtggtccagccgtgggagtcacagagactctcctgtncagcctcgtgggttcaccttcagtagctacggcatgcacgtgggtccnccaagcctccgaggcgaaggggtattgggaggtgggtggctaggtttgtttcagttcgtggacgggctaggttgttacaagttgggtatggaccaaggtaccgtccgggtaggaacggggtcctacttccgaaccacgttcctaccgtaaggaacgtaaactaaacgtttacccgaaacgggaaaccaactaaagttaggtttaaagtttaagggggaaaatttacggaaaaccgtacggtaacccttaaacggttcccgtaaggaacggggtacgtaacggggttagttaaacgttaacgtaacgtagggttaaacgggaaacgggggttaacggggggaaacccggaagggttaccggggttacgtttaacccggtaaaggttacccgttaaccgtttacgggtaccggttaccgggtcgggggttaacccggttaacccgggg

SEQ ID NO: 357600 - DNA, 616 bp, Homo sapiens
  misc_feature: GZ8MTXP01AWV9G.10.44.D11.1.454.CMB.2.raw
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
  modified_base (297)..(297): a, c, t, g, unknown or other
  misc_feature (297)..(297): n is a, c, g, or t
  modified_base (320)..(320): a, c, t, g, unknown or other
  misc_feature (320)..(320): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagcctggggagtcacagagactctcctgtgcagcctgtgggttcaccttnagtanctacggcatgcacgtcgggtcccnccaagcctccgaggcgaagggtnttgggaggtgggtgctaggtttgttcatcgtggacggctaggtgtacaagttgggtatgacagtacctccggagaacggggctattccacatccacagacgaacattaccgaaaggaacaactaagttagttaacgtttaaggggaaaattacgaaaccacgtaaccgtaacgtccgtaggacggtacgtacgggttataacgtacgtaacgtaggttaacggaaaggggacggggaacagggacgggttacttaccgaacgttcttcgttggacgttcggtcgggcgtaaccggg

SEQ ID NO: 357601 - DNA, 827 bp, Homo sapiens
  misc_feature: GZ8MTXP01BH4LA.10.44.D11.1.454.CMB.2.raw
  modified_base (296)..(296): a, c, t, g, unknown or other
  misc_feature (296)..(296): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggagtcacagagactctcctgtgcagcctcgtgggttcaccttcagtagctacggcatgcacgtcgggccnccaagcctccgaggcgaaggggattgggagtggggtgctaggtttgtttcatcgtggacgggctaggttgtcaagttgggtatcggactaaggaccttccggtaggaaacggggtcctaattaccaacctactccgtaccgaaggaacgtaaacgtaacttacccgaaacgggtaaacctaaaccgtaaagtttacggttaaagttttaagggggaaaacgtttaacggaaaaccgtaaacggttaacccgttaaacgggttacccgtaagggtaaacggggtaaccggttaaacgggggttacgttaaacgttaaccggttaaaccggttaacgggggttaaaccgggggaaaacggggggttaaaccgggggggggtaaaacccgaacggggggttaacccggggggttaaccgggtttaaaccccggtaaaacgggggtttaaccccgtttaacccgggtttttaaccgggtaacccgggtttacccggggttaaccggggggttaaccccggttaaaccccgggggg

SEQ ID NO: 357602 - DNA, 580 bp, Homo sapiens
  misc_feature: GZ8MTXP01EZ294.10.44.D11.1.454.CMB.2.raw
  modified_base (271)..(271): a, c, t, g, unknown or other
  misc_feature (271)..(271): n is a, c, g, or t
  modified_base (317)..(317): a, c, t, g, unknown or other
  misc_feature (317)..(317): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctctgggttcaccttcagtanctacggcatgcacgtcgggcccgccaagcctccgaggcaaaggggnttgggaggtggggtgctaggtttgttcatcgtggagggcaggtgtcaagtggtatgcagactccgtgaacgggcatcacatctcagagacaatccagaacacaatagtattaggggaaatagaacagacctaagtccgtagacggacgtacgggttagtatacgtaacgtggttaacggaaggggacgggggaaaccgagggacgggttacgttaccgaagtaccgtcgtttggacggttcggtcggggttcccgtaacgggg

SEQ ID NO: 357603 - DNA, 742 bp, Homo sapiens
  misc_feature: GZ8MTXP01AD4FM.10.44.D11.1.454.CMB.2.raw
  modified_base (295)..(295): a, c, t, g, unknown or other
  misc_feature (295)..(295): n is a, c, g, or t
  modified_base (316)..(316): a, c, t, g, unknown or other
  misc_feature (316)..(316): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctggggagtcacagagactctcctgtgcagcctcgtgggttcaccttcagtagctacggcatgcacgtgggtccnccaagctccgaggcaagggtnttgggagtgggtgctaggttgttcatcgtaggacggggtcaggttgttacaagtgggtaatggacaaggtacccttccgggtagggaacgggggtccctaatttacccaacctactaccgtacccgaaggtacgaaacctaaacttacccgaaacgggtaaaccaaaccgtaaagttaggtttaaacgttttaacggggggtaaaattacggaaaccgtaccggtaacccgttaaacggtacccgttaggaacgggtaaccgtaaccgggggtattaacgtaaccgttaacggtagggttaaacggggaaacgggggaaacggggggtaaaccgacggggaccggggttacgttacccggtaaaggttacccgttaaccgtttcggtaccgggttcggtccgggggttaacccggtaacccggggg

SEQ ID NO: 357604 - DNA, 649 bp, Homo sapiens
  misc_feature: GZ8MTXP01EZPA2.10.44.D11.1.454.CMB.2.raw
  modified_base (269)..(269): a, c, t, g, unknown or other
  misc_feature (269)..(269): n is a, c, g, or t
  modified_base (298)..(298): a, c, t, g, unknown or other
  misc_feature (298)..(298): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggagcgtggtccagccgtgggagtcacagagactctcctgtgcagcctcgtgggttcaccttnagtagctacggcatgcacgtcgggtcccnccaagcctccgaggccgaaggggtagttgggaggttgggggtggtctaggtttgtttacagttcgtggagggtctagttgtacaagttgggtatgacgagaccgttccggtagggaacgggccgtaattcccaacctatcctacgaagacgtaaccaaacgttcccgaacggaaaccaactaaagttagttaagtttaggggaaacgttagaaactacggacctaaacgtccgtaggacggtacgtacgggtagtaactagtaacgtaggttacggaaggggaaggggaaccgaggcgggttagttaccgaagttaccgtcgttggacggttcggtcgggccgtaaccggg

SEQ ID NO: 357605 - DNA, 570 bp, Homo sapiens
  misc_feature: GZ8MTXP01CJN0Z.10.44.D11.1.454.CMB.2.raw
  modified_base (299)..(299): a, c, t, g, unknown or other
  misc_feature (299)..(299): n is a, c, g, or t
  modified_base (320)..(320): a, c, t, g, unknown or other
  misc_feature (320)..(320): n is a, c, g, or t
  modified_base (474)..(474): a, c, t, g, unknown or other
  misc_feature (474)..(474): n is a, c, g, or t
  modified_base (487)..(487): a, c, t, g, unknown or other
  misc_feature (487)..(487): n is a, c, g, or t
  modified_base (513)..(513): a, c, t, g, unknown or other
  misc_feature (513)..(513): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggaggcgtggtccagcctgggaggtcacagagactctcctgtgcagcctctgggttcaccttcagtagctacggcatgccacgtcgggtcccnccaagcctccaggcaaggggnttgggaggtgggggtgctaggtttgtttcagttcgtggacgggctagtgttcaatgggtatgcagactcgaggacgggcattccacatctccagagacaatcagaacacaatgtattgggaatgaacagacctaagccagacggactacgggtntacgtactaacgnggttacggaaggggacggggaaacgngggacgggttagttccaaggtcttccgttggacggttcgtcgggggcccgtaacggg

SEQ ID NO: 357606 - DNA, 761 bp, Homo sapiens
  misc_feature: GZ8MTXP01BLNMB.10.44.D11.1.454.CMB.2.raw
  modified_base (297)..(297): a, c, t, g, unknown or other
  misc_feature (297)..(297): n is a, c, g, or t
  modified_base (319)..(319): a, c, t, g, unknown or other
  misc_feature (319)..(319): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtggagtcgtgggggaggcgtggtccagcctgggaggtcacagagactctctgtgcagcctcgtgggttcaccttcagtgctacggcatgcacgtcgggtcccncaagcctccgaggcaaaggggnttgggagtggggtgctaggttgtttcatcgtggacgggctaggttgtacaagttgggtaatcgacaggtacccgttccgggaggaaacggggtcctaattccaccgtactcctaccgaaggaacgtaactaaacgttacccgaaacggtaaaccaaacgtaaagttacgttaaagtttaaggggtaaaacgttacgggtaaacctaacggtaacccgttaaacggttacccgtaagggtaaacgggtaaccggtaacgggggttacgttaaacgttaaaccgtaacggttaacgggttaaaccggggtaaaaggggggaacgggggggtaaaacccgaagggggttaaccgggggttacgtttaacccggtaaaggttacccgtttaaccgtttacgggtaaccggttcgggtaaccgggggttaacccgttaacccggggg

SEQ ID NO: 357607 - DNA, 670 bp, Homo sapiens
  misc_feature: GZ8MTXP01AVX53.10.44.D11.1.454.CMB.2.raw
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagtcctcgtgggttcaccttcagtagctacggcatgcacgtcgggtcccncaagcctccgaggcaaggggnttgggaggtgggggtgcgtagtttgttcagttcgtggacggggtctaggttgttacaaagttgggtaatggcgaacggtacgtccgggtaggaacggggtcctaaattccacctactcctaccgaagaacgtaacaaacttaccgaaggaaacctactaaagttgttaaagtttagggggaaaattacggaaacacggtacctaacggtccgtaggaacggtacgtacggggtatacgttaacgtaacgtaggttacgggaaaggggacgggggaaacccgagggccgggttagttacccgaaggttccttcgtttcggacggttacggtcggggttaacccgtaaccgggg

SEQ ID NO: 357608 - DNA, 575 bp, Homo sapiens
  misc_feature: GZ8MTXP01EULNK.10.44.D11.1.454.CMB.2.raw
  modified_base (267)..(267): a, c, t, g, unknown or other
  misc_feature (267)..(267): n is a, c, g, or t
  modified_base (296)..(296): a, c, t, g, unknown or other
  misc_feature (296)..(296): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagccgtgggagtcacagagactctctgtgcagcctcgtgggtcaccttnagtagctacggcatgcacgtcgggtcccnccaagcctccgagggccgaaagggggtattggggaggttgggggtggctaggtttgtttcagttcgtggacgggctagtgtacaagtggtatgcagctcgtaggaacgggctatcacntcncagagacatcagaacacaatagtattaggggaatgaacagacctagccgtaggaacggcgtagggtatactacgtaacgtaggttaacggaaggggacggggaaccagggcggttagttaccgaagtctcgttgacgttcggcgggttccgtaacggg

SEQ ID NO: 357609 - DNA, 636 bp, Homo sapiens
  misc_feature: GZ8MTXP01E0MSC.10.44.D11.1.454.CMB.2.raw
  modified_base (202)..(202): a, c, t, g, unknown or other
  misc_feature (202)..(202): n is a, c, g, or t
  modified_base (258)..(258): a, c, t, g, unknown or other
  misc_feature (258)..(258): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (311)..(311): a, c, t, g, unknown or other
  misc_feature (311)..(311): n is a, c, g, or t
  modified_base (392)..(392): a, c, t, g, unknown or other
  misc_feature (392)..(392): n is a, c, g, or t
  modified_base (425)..(425): a, c, t, g, unknown or other
  misc_feature (425)..(425): n is a, c, g, or t
tcagcatagtagtgcacgaccggtgctcgatttagcgcagtacgaaggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangcccacctctcctgcagggccagtcagagtgttggcgctacgtagcctggaccaanagaacctggaccaggcctcccacggcccctnatctatggtncactaccaacgngggccacgtggcactcccagcctaggttcaggtggccgtaggtgggtctgggacaacgtactcactctacactatcatcancgtggacgctagagtattgttgcgttaagtttnttacgtagtacaacgtacgtaccggtacggacggtccgggtcccggtcccgggggtccttacccggtttcccgggtccccggttacggggtaaacccgtaaagggttaacggtaaagttaacgtaaaccggttaaaaccggtacgttacggttacgggttcgttacggaaccctactaacgttcgttcgttcctttcttaacgtttccccg

SEQ ID NO: 357610 - DNA, 631 bp, Homo sapiens
  misc_feature: GZ8MTXP01D817Z.10.44.D11.1.454.CMB.2.raw
  modified_base (275)..(275): a, c, t, g, unknown or other
  misc_feature (275)..(275): n is a, c, g, or t
tcagcatagtagtgcacgaccggtgctcgatttagcgcagtacgaaggggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggaggtcgtgggggaggcgtggtccagccgtgggaggtcacagagactctcctgtgcagcctcgtgggttcaccttnagtagctacggcatgcacgtcgggtcccgcaagcctaccgaggcgaaggggtattgggaggtgggggtggctaggtttgttcagtcgtggacggctagtgtacaagtggtatgctagtaccgtccgtaggacgggctactcacatcacagacgaactatacaagaacactaatagtaagtttaaggaaatgaaactacgtacctaacgtccgtaggaacggaccgtaggggtataacgtactaacggtaggttaaacggggaagggggaacgggggaaacctaggggttacgggttacgttaccgtaaggttccttcgtttacggacggttccggtaacggggccgtaacccgggg

SEQ ID NO: 357611 - DNA, 639 bp, Homo sapiens
  misc_feature: GZ8MTXP01BE1SS.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggaggcgtggtccagccgtgggaggtcacagagacctctcctgtcgcagccctcgtgggttccacccttcgagtacgcgtacggcagtcgcacgtcgggtccccgaccaaggcctccgaggcgaaaggggtagttggggaggttgggggtagcgtaggtttgttcagtcgtaggacgggctaggtgttacaagttggtatggacagtaccgtccggtagacggggctacgtccacatcctcagacgaactacttaccaagaacactaagtagttaagttagggaaatagaaacacgtactaacgtccgtaggaacgtacgtacgggtagtaactacgtaacgtaggaacgggtaacgggaagggggaaaccgagggacgggttacgttacgtaagtaccgtcgttcgacggttcggtcgggttcgtaaccggg

SEQ ID NO: 357612 - DNA, 650 bp, Homo sapiens
  misc_feature: GZ8MTXP01DNHKV.10.44.D11.1.454.CMB.2.raw
  modified_base (297)..(297): a, c, t, g, unknown or other
  misc_feature (297)..(297): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggaggcgtggtccagcctgggagtcacagagactctcctgtgcagcctcgtgggtcaccttcagtagctacggcatgcacgtcgggtcccncaagcctccgaggacgaaggggtattggggagtggggtgctaggtttgtttcatcgtggagggtcaggttgtacaaagttgggtaatggactaaggaccttccggtagggaacggggtcctattaccgacctactcctaccgaagaacgaacaacttaccgaagaacaacaatagttaagttaggggaaatacggaaacacgtaccgtaaacgtccgtaggaacggacgtacgggtagtaactaacgtaacgtaggttaacgggaaacggggaacgggggaaaccgagggacgggttacgttaccgaagttaccttcgtttacggaccggttcggtcggggccgtaaccgggg

SEQ ID NO: 357613 - DNA, 580 bp, Homo sapiens
  misc_feature: GZ8MTXP01A4M5X.10.44.D11.1.454.CMB.2.raw
  modified_base (280)..(280): a, c, t, g, unknown or other
  misc_feature (280)..(280): n is a, c, g, or t
  modified_base (304)..(304): a, c, t, g, unknown or other
  misc_feature (304)..(304): n is a, c, g, or t
  modified_base (328)..(328): a, c, t, g, unknown or other
  misc_feature (328)..(328): n is a, c, g, or t
  modified_base (424)..(424): a, c, t, g, unknown or other
  misc_feature (424)..(424): n is a, c, g, or t
  modified_base (436)..(436): a, c, t, g, unknown or other
  misc_feature (436)..(436): n is a, c, g, or t
  modified_base (481)..(481): a, c, t, g, unknown or other
  misc_feature (481)..(481): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagacgtggtccaggccgtggggagtcacagagactctcctgtgcagcctcgtgggttccaccttcagtanctacggcatgcacgtcgggtcccnccaagcctccgaggcgaaggggtnttggggaggtggggtgctaggtttgtttcagtcgtggcgggtctaggttgtacaagtggtatgcagactcgtaggacgggccatcacatcacaganacatcagaacanatatataggaatagaacagtactaagtcgtagagacgtacgggtntactactaacgtaggttaacgggaaggggacggggaacgacgggacggttacgttaccgtaagtcgttcgttggacggttcgtcggggccgtaaccggg

SEQ ID NO: 357614 - DNA, 773 bp, Homo sapiens
  misc_feature: GZ8MTXP01BXPGM.10.44.D11.1.454.CMB.2.raw
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
  modified_base (320)..(320): a, c, t, g, unknown or other
  misc_feature (320)..(320): n is a, c, g, or t
tcagcatagtagtgcacgaccggtgctcgatttagcgcagtacgaagggggggagaggagcccagcactagaagtcggcggtgtttccattcggtgatcagcactgaacacagaggacctcaccatggagtttgggctgaactgggttttcctcgttgctcttttaagaggtgtccagtgtcaagtgcaactggtggagtcgtgggggaggcgtggtccagccgtgggagtcacagagactctcctgtgcagcctcgtgggttcaccttnagtgctacggcatgcacgtcgggtcccnccaagcctccgaggcaaggggnttgggaggtggggtgcgtaggtttgtttcagtcgtggacggctaggtgttacaagttgggtatcggactaggaccgttccggtagggaaacggggtcccgtaatttcccaaccctagtccctaccgaaacggacgtaaacctaacgttacccgaaacgggtaaaccaacgtaaagttacggtttaaagttttaagggggaaaactttacggaaaaccgtaacggttaaccccgttaaacggttccccgtaaggggtaaacgggtaaccggtaaccgggggttaacgttaaacgttaaccgttaaacggttaacggggttaaacggggaaacgggggttaacggggggaaacccgtagggggttaccggggttacgtttacccggaaacggtttacccgttccggtttcgggacccgggttacgggtccgggggttaacccggttaacccgggg

SEQ ID NO: 357615 - DNA, 751 bp, Homo sapiens
  misc_feature: GZ8MTXP01BCYIW.10.44.D11.1.454.CMB.2.raw
  modified_base (271)..(271): a, c, t, g, unknown or other
  misc_feature (271)..(271): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggaggtcgtgggggaggcgtggtccagccgtgggagtcacagagactctcctgtgcagcctcgttgggttcaccttnagtacgcgtacggcagtcgccacgtcgggtcccacctaagcccgtaccgaggcgaaggggtagttgggaggtggggtgcgttaggtttgttcagtcgtaggacggtactaggttgtacgtaagttgggtatcggacgtaaacgtcccgtaccgggtaggtaaccgggggcctaacgttacccacctacttccgtaccgaacgtaacgtaaaccgtaaacgttacccgaaacgggtaaacaaaccgttaaagttaggttaacgtttaaggggaaacttaacggaaaccgtacgtaaccgtaacgtccgtaggtaacggtacgtaacgggttagtaaccgtacgtaagtaacgggttaaacggggaacggggttaacgggggaaccgtagggaccgggttaacgttacccgtaacgggttacccttaaccggtttacgggacccgggttcggtaaccgggggttaacccgttaacccggggg

SEQ ID NO: 357616 - DNA, 726 bp, Homo sapiens
  misc_feature: GZ8MTXP01DJQGO.10.44.D11.1.454.CMB.2.raw
  modified_base (632)..(632): a, c, t, g, unknown or other
  misc_feature (632)..(632): n is a, c, g, or t
tcagcatagtagtgcacgaccggtgctcgatttagcgcagtacgaaggggggggagaggagcccagcactagaagtcggcggtgtttccattcggtgatcagcactgaacacagaggactcaccatggagtttgggctgaacttgggttttcctcgttgcttcttttaaagaggtgtccagtgtcaagtgacaacgtggtggagtcggtggggggagcgtggtccagccgtgggagtcacagagactctcctgtgcagtcctcgttgggttccaccttcagtagctacggcatgcacgtcgggtacccacaagcctaccgaggacgaaaggggtattgggaggtgggggtgtactaggtttcgtttacagtcgtaggacgggctaaggttgttacaagttgggtaatgacgtagtaccgtacgggtaggaaacgggtcctaattccaacctatctacgaaggtaacaaactaactaccgaaagaaaccaaataagttagttaaagttaaggggaaaacttcggaaaacctacgtaacccttaaacgttccgaaggaaacggtacgtaacggggttataacgtaacgtaacgtaagggaaacggggtaaacgggggaacgggggtaaacccgnggggttaaccggggttacgtttaaaccgtaaacggttacctttccggtttacggacgggttccgggtaacgggggaaccccgtttaaccggggg

SEQ ID NO: 357617 - DNA, 787 bp, Homo sapiens
  misc_feature: GZ8MTXP01DZ9W7.10.44.D11.1.454.CMB.2.raw
  modified_base (326)..(326): a, c, t, g, unknown or other
  misc_feature (326)..(326): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactctcctgtgcagtcctcgtgggttcaccttcagtagctacggcatgcacgtcgggtcccacaagcctaccgaggacgaaggggtnttgggaggtgggtggctaggtttgtttcagttcgtggacgggctaggttcgttacaaagttgggtatcggactaacgggtacccgttccgggtaggaaaccgggggtcccctaatttacccgaaccctacgttcccgtaccgaaaggtaacgtaaacctaaacgttacccgaaagggtaaaccaaacgtaaagttaggtttaaacgtttaagggggaaaattacggtaaacctaacggtaccgttaaacggttcccgtaagggtaaaccgggtacgtaacgggggttacttaaacgttaaccgtaaacggtaacgggttaaacggggaaacgggggttaaacggggggaaacccgtaaggggttaccgggggttaacgttaacccggtaaaggttacccgtttaaccggtttacgggtaccgggttaccgggtaaccgggggttaacccgtaacccggggg

SEQ ID NO: 357618 - DNA, 788 bp, Homo sapiens
  misc_feature: GZ8MTXP01A1I2W.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtggggagcgtggtccagccgtgggagtcacagagactctcctgtcgcacgcctcgttgggttccaccctttcgaggtacgccgtacggcagttcgctacgtcggggtccccgaccaaacggtccctaccggaggaccgaaagggggtgtttagggggagggttgggggtcgggtcgttaaggttttcgtttacaagttcgtagggacgggtactaggttcggtttaccaaaggtttgggtaacgtcggaccgtaaacgggtacccgttaccgggtagggaaaccggggtccctaacttacccgacctacgtaccgtaccgaaggaacgtaaccgtaaacgttccgaaacggtaaacaacgtaaagttagtttaacgtttaaggggaaacttacggaaactaacggtaccttaaacggtcccgtaggaacggtaccgtacgggtagttaacgtaccgtaacgttacgggttaacgggaaacgggggacgggggtaaaccgaggggttaccgggttacgttacccggtaagttaccgttcgtttacgggtaccggttccgggtaacggggttccccggttaaccgggg

SEQ ID NO: 357619 - DNA, 680 bp, Homo sapiens
  misc_feature: GZ8MTXP01CBGO0.10.44.D11.1.454.CMB.2.raw
  modified_base (270)..(270): a, c, t, g, unknown or other
  misc_feature (270)..(270): n is a, c, g, or t
  modified_base (320)..(320): a, c, t, g, unknown or other
  misc_feature (320)..(320): n is a, c, g, or t
  modified_base (629)..(629): a, c, t, g, unknown or other
  misc_feature (629)..(629): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggaggcgtggtccagccgtgggagtcacagagactctcctgtgcagcctcgtgggttcaccttnagtagctacggcatgcacgtcggtcccacaagcctccgaggcaaggggtnttgggaggtgggtgctaggtttgttcagtcgtggacgggtctaggttcgttacaaggttcgggtatcggactaacggtaccgtcgggtaagggaacggggccctaaagtttcccaaccgtactaccgtaccgaacgtaacgtaaacctaaacgttaccgaaaggtaaaccaacgtaaagttacggttaaagttttaaaggggaaaacttacggaaacctacgtaaccgttaaacggtcccgtaaggaacggtacgtaccggggtataacttaacgtaacgtaggttaaacggaaggggacggggaaacngggacggttacttacgaagtctcgttcgcgttcggtcgggccgtaaccggg

SEQ ID NO: 357620 - DNA, 679 bp, Homo sapiens
  misc_feature: GZ8MTXP01D0E41.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgcttcttttaagaggtgtccagtgtcaagtgcaacgtggtggagtcgtgggggagtcgtggtccagccgtgggagtcacagagtactctcctgtgcagtcctcgtgggttctaccttcagtagctacggcatcgacacgtcgggtcccacaagcctaccgaggccgaaaggggtattggggaggttgggggtcggtactaggttttgtttacgagtcgtaggagggtctaaggttcgttacaagttggatgacaggtacctccggtaggaacgggcctattaccgactattcacaagacgtaactacttaccaagaacaactaattagtaagtttaggggaaaactcgaaacacgtaaccgtaaacgtccgtaggaaacgggtactaccggggttataacgttaacgtaaacgttgggaaaccgggaaagggggaaacggggaaaccgagggttaaccgggttcttaaccgaacggttaccttccggtttaggacgttacgggtcggggcccgttaaccgggg

SEQ ID NO: 357621 - DNA, 662 bp, Homo sapiens
  misc_feature: GZ8MTXP01DHTV6.10.44.D11.1.454.CMB.2.raw
  modified_base (295)..(295): a, c, t, g, unknown or other
  misc_feature (295)..(295): n is a, c, g, or t
  modified_base (316)..(316): a, c, t, g, unknown or other
  misc_feature (316)..(316): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttggctgaactgggttttcctcgttgcttcttttaagaggtgtccagtgtcaagtgcaacgtggtggagtcgtgggggaggcgtggtccagcctgggaggtcacagagactctcctgtgcagcctcgtggtcaccttcagtagcacggcatgcacgtcgggtccncaagcctccgaggcgaagggnttggagtgggtgctagttgttacagtcgtggacggggctaggttcgtacaagtgggtaatgacgtagaccgttccgagggaacggggtcctaagttaccacccagttcccgaccaaggaacaactaaacttccgaaacggaaaccaacgtaaattagtttaaagtttaagggggaaacttaggaaaccgtacgtaccgtaaacgtcccgtaggaacgtacgtacggggtataacgtacgttaacgtaggttaaacggaaacggggaacgggggaacctagggcgggttacgttaccgtaacgtacgtccgtttaggaccggttcgtccgggggccgttaaccgggg

SEQ ID NO: 357622 - DNA, 845 bp, Homo sapiens
  misc_feature: GZ8MTXP01BUHR7.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactctcctgtgccagtcccttcgtgggttcctaccgttcgaaggtacgccgtacggcagtcgaccacggtcgggtaccccgacctaaagccgtaccgaagggacgtaaagggggtatttgggggagggttgggggtacggtcgtaaggttttcgtttacagttcgtagggacgggtctaggttcgttacgtaaagttcgggtaatggaccgtaacggtacccgttaccggtagggaaaccggggtcctaacttacccgaacctactccgtaccgaaagaacggtaaacctaaacgttacccgaaaggtaaacctaacgtaaagtttagttaaagtttaagggggaaaactttacggaaacgtaccggtaaacccgttaaaggtaccccgtaggggtaaaccggtaccggttaacggggttaacgttaaacgttaaccggttaaacggttaacgggggttaaaccggggaaaacggggggttaacgggggaaacccgtagggggttaacccgggggttacgttaaaccccggtaaaggtttacccgttaacccggttttacgggaccggttaccggggtccgggggttaaccccgttaacccggggg

SEQ ID NO: 357623 - DNA, 713 bp, Homo sapiens
  misc_feature: GZ8MTXP01DEYZU.10.44.D11.1.454.CMB.2.raw
  modified_base (379)..(379): a, c, t, g, unknown or other
  misc_feature (379)..(379): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtggagtcgtgggggaggcgtggtccaggcctgggaggtcacagagactctcctgtgcagcctcgtgggttcaccttcagtagctacggcagtgcactcggggtcccacaaggcctaccgaggccgaaagggggtatttgggaggtgggtggtcaggtttcgttcatcgtaggacggggctaggtnttacaaagttgggtaatgacgagtaccgtccggtaggaacggggcattcactatctacagtaagaactaacttaccgaagaaacactaaattagttaatttagggggaaaattcggaaaactacggtaccttaaacgtcccgtaaggtaagggaccgtaacggggttagtaaacttaacgtaacggtaagggttaaaccggggtaaaagggggacggggggtaaaacccgaacggggttaaccgggggttacgttacccgggtaaaacggttacccgtttccggttttacgggaccgggtttaccggtcgggggttaacccgttaacccggggg

SEQ ID NO: 357624 - DNA, 705 bp, Homo sapiens
  misc_feature: GZ8MTXP01C5R9U.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcctgtgcagcctcgtgggttccaccttcagtagctacggcatgcacgtcgggtcccacaagcctaccgaggcgaaggggattggggaggtggggtgctaggtttgtttcagtcgtggacggtctaggttgttcaagttgggtaatggacaacggtaccgttcccgggtagggaacggggccgtaatttacccgacctaacttcctaccgaaggtaacgaaactaacttaccgaaaggaacctaacgtaaagttagtttaagtttaagggggtaaaacttacggaaaacctacggtacccgttaaacggtcccgtaaggaacggaccgtacgggttatacgttaacgtaacggtacgggttaacgggaaagggggaaccgggggaaacgacgggttacgggttacgttaccgaacgttacgtccgtttacggaccggttacggtcggggaacccgttaaccgggg

SEQ ID NO: 357625 - DNA, 576 bp, Homo sapiens
  misc_feature: GZ8MTXP01E00X3.10.44.D11.1.454.CMB.2.raw
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
  modified_base (369)..(369): a, c, t, g, unknown or other
  misc_feature (369)..(369): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtggggagcgtggtccagcctgggagtcacagagactctcctgtgcagcctctgggttcaccttcagtagctacggcatgcactgggtccncaagctccaggcaagggnttggagtgggtgcagttgttcatcgtgacgggcagtgtcaagtggtatgcagactcgngaacgggctatcacatctcagagacaataccagaacacaatgtatttacggggaatagaacgagacctaacggtccctaggacggacgtacgggtatactactaacgtagttacggaaagggttacgggggaaaccgaggcgggttacgttaccgtaacgtaccgtccgtttcggaccggttccggtcggggcccgtaacccggggg

SEQ ID NO: 357626 - DNA, 723 bp, Homo sapiens
  misc_feature: GZ8MTXP01B1V3L.10.44.D11.1.454.CMB.2.raw
  modified_base (269)..(269): a, c, t, g, unknown or other
  misc_feature (269)..(269): n is a, c, g, or t
  modified_base (636)..(636): a, c, t, g, unknown or other
  misc_feature (636)..(636): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagcctgggagtcacagagactctctgtgcagcctcgtgggttcaccttnagtagctacggcagtgccacgtcgggtccccacaagcctcccgaaggcgaaaggggtattgggggaggttcggggtgctaggtttgtttcatcgtggacgggtctagttgtacaagtgggtatcggactaggaccttccgggtagaaacggggccctaattccgaacctacttcgaccgaagaacgtaaactaaacttacccgaaggtaaccaactaattagttaaacgtttaacgggggaaaattcggaaactaacgtaacccgttaaaggtaccgtagggtaaacgggtacgtaacgggggttaacttaacgtaacccgttaacggtaacgggttaaacggggaaggggaacgggggtaaaccgnggggttaccgggttaacgttacccgtaaacggttacctttaaccggtttcggaccggttccggtcgggggaacccgttaaccggggg

SEQ ID NO: 357627 - DNA, 706 bp, Homo sapiens
  misc_feature: GZ8MTXP01A34XS.10.44.D11.1.454.CMB.2.raw
  modified_base (588)..(588): a, c, t, g, unknown or other
  misc_feature (588)..(588): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagacgtggtccagcctgggagtcacagagactctcctgtgcagcctcgttgggttcaccttcagtagcgtacggcatgcacgtcgggtcccgaccaagcctaccgaggacgaaaggggtattgggaggtggggtgcgtagttgtttcagtcgtggacggctaggttgtacgaagtaggttaatcggactaacggtaccggtacccggtagggaaacgggggtcctaactttacccgaacctacgtaccctacccgaaggtaacgaaacctaaacgttacccggaaaggaaacctaacgtaaagttagttaagtttaacggggaaaattaggaaaaccgtacgtaccgtaacgtacccgtaggaaacggacgtaacggggtntaactacgtaacgtaggttaacgggaaagggggaacggggaaacccagggccgggttaagttacccgtaagtaccgttcgttggaacggttcggtaacggggaacccgttaaccgggg

SEQ ID NO: 357628 - DNA, 753 bp, Homo sapiens
  misc_feature: GZ8MTXP01AX6O7.10.44.D11.1.454.CMB.2.raw
  modified_base (285)..(285): a, c, t, g, unknown or other
  misc_feature (285)..(285): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtggggagcgtggtccagccgtgggagtcacagagactctcctgtgcagtcctgttgggtcctaccttcgagtacgctacggnagtcgcctacgtcgggtccccgacaagccctacccggaggaccgaagggggtagttggggaggtgggggtgacgtaggttttgttacagtcgtggacggtctagttgtactagttaggtatcggtacacgtacgtaccggtagggaacggggcctactaccacctacgttcctaccgaaagacgtaaacctaaacgttaccgaaacggtaaacaacgtaaagttaggtttaaacgttaagggggtaaaattaccggaaaccgtaacgggttaaccctaaacggttacccggttaaggaaaccgggtaacggtaaccgggttagttaaaccgttaaacggttaacggtaacgggttaaacggggaaaccgggggaagggggtaaaccgaaggggttaccgggttacgttacccgaagttccgttaacgtttcggacggttaccgggtcggggaacccgttaacccgggg

SEQ ID NO: 357629 - DNA, 724 bp, Homo sapiens
  misc_feature: GZ8MTXP01DYSYU.10.44.D11.1.454.CMB.2.raw
  modified_base (272)..(272): a, c, t, g, unknown or other
  misc_feature (272)..(272): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggaggcgtggtccagccgtgggaggtcacagagactctcctgtgcagcctcgtgggttccaccttnagtagctacggcatgcacgtcgggtcccacaagcctaccgaggcgaaaggggtattgggaggtggggtgctagtttgtttcatcgtggacggctagttgtacaagttgtatggacagtaccctccggtaggaacggggtcctaacttcaaccacttccgaccgaagtaacgaaacctaaacgttacccgaaagggtaaaccaacgtaaagttagttaagttttaaagggggaaaatttacggtaaaaccgacgtaacccgttaaaacggttcccgtaaggaaaccgggtacgtaacggggttagtaaacttaacgtaacgttagggaaacgggtaaacgggggaacggggggaaaccaacggggttaccggggttaacgttaccgtaaacgggttacccttccggtttacgggaccggttccgggtaaccgggggcccgttaaacccggggg

SEQ ID NO: 357630 - DNA, 598 bp, Homo sapiens
  misc_feature: GZ8MTXP01CA4KX.10.44.D11.1.454.CMB.2.raw
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
  modified_base (324)..(324): a, c, t, g, unknown or other
  misc_feature (324)..(324): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (527)..(527): a, c, t, g, unknown or other
  misc_feature (527)..(527): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggagcgtggtccagccgtgggaggtcacagagactctcctgtgcngcctgtgggtcaccttnagtagctacggcatcgcacgtcgggtccccgcaagcctaccgaggcgaaagggggnttagggaggtgggggtgtctaggtttgttcagtcgtggacggctagtgtacaagtgtatgcagctcgaggacgggcatcacntcncaganacactcagaacactaatgtagttaggaatagaacagtacctaagtccgtagaacggacgtacggtagtactaacgtaacgtaggttacgggaaaggggacgggggtaaaccgngggacgggttacgttaccgtaacggttaccgttcgttggaccgttcgggtaacggggttccgtaaccgggg

SEQ ID NO: 357631 - DNA, 701 bp, Homo sapiens
  misc_feature: GZ8MTXP01BZQEI.10.44.D11.1.454.CMB.2.raw
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctctgggttcaccttcagtagctacggcatgcacgtgggtcccnccaagcctccgaggcaagggnttggagtgggtgctagttgttcatcgtggacgggctagtgttacaagttgggtatggcagaccgtccggtaggaacggggcctattccacctactcctaccgagacgaactaacttacccgaacggtaaccaactaagttagttaagtttaagggggaaaattacggaaaccgtaacggtacccgtaaacggtcccgtaggtaacgggtaccgtaaccggggttagttaaccttaacgttaaccgttagggttaaaccggggtaaagggggaacggggggaaacccgaacggggttaccggggttacggtttacccggtaaacggttacccgttaaccgtttacggtaccgggttccggtaaccgggggttccccgtaaccggggg

SEQ ID NO: 357632 - DNA, 708 bp, Homo sapiens
  misc_feature: GZ8MTXP01AYL8Q.10.44.D11.1.454.CMB.2.raw
  modified_base (296)..(296): a, c, t, g, unknown or other
  misc_feature (296)..(296): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggagtcacagagactctcctgtgcagcctcgtgggttcaccttcagtagctacggcatgcacgtcgggtccnccaagcctccgaggcgaaggggtattgggaggtggggtgcgtaggtttgttcagtcgtggacggctagtgtacaagtgggtatgactaggacctccggtaggaacgggccgtaattccaccgtactacgtaccaagacgtaactaacgttaccgaaacggtaaaccaaactaaagttagttaagtttaagggggtaaaattacggtaaacctaacggtaaccgtaaacgtcccgttaggaaacgggacgtaaccggggtagttaacgtaacgttaacgtacgggttaaacgggaaacgggggttaacggggggaaaccgacgggttacggggttacgttacccgtaagggttacccgttaaccggttacggtaccgggttacgggtccgggggttaaccgttaacccggggg

SEQ ID NO: 357633 - DNA, 619 bp, Homo sapiens
  misc_feature: GZ8MTXP01BEOWS.10.44.D11.1.454.CMB.2.raw
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (339)..(339): a, c, t, g, unknown or other
  misc_feature (339)..(339): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgcttcttttaagaggtcgtccagtgtcaagtgcaacgtggtggagtcgtgggggagcgtggtccaggccgtgggagtcacagagtactctctgtgcagcctcgtggtcacttnagtncacggcagtcgcacgtggccncaagctcgagcgaaggggtntgggaggtgggtacgctaggtttnttcagtcggtaggtacggctaagttgttacagttgtatgactagtacgtcggtaggacgggctatcactatctaccagagaacaacttacgaacgtaacaactaatagttaagttagggaaatcgaaacacggtacctaacgtccgtagacgtacgtaggtacgtagtaactaaggtaacggttaaacgggaagggaacggggaaacgtgggttaacgttacgttaacgtaacgttaccgtccgtttaggaccgttcgggtcgggttcccgtaaccgggg

SEQ ID NO: 357634 - DNA, 699 bp, Homo sapiens
  misc_feature: GZ8MTXP01AB7Y2.10.44.D11.1.454.CMB.2.raw
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
  modified_base (313)..(313): a, c, t, g, unknown or other
  misc_feature (313)..(313): n is a, c, g, or t
  modified_base (327)..(327): a, c, t, g, unknown or other
  misc_feature (327)..(327): n is a, c, g, or t
  modified_base (337)..(337): a, c, t, g, unknown or other
  misc_feature (337)..(337): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctctggtcacttcagtncacggcatgcacgtgggtcccncaagcctaccgaggcaaaggggtnttggaggttggggngactagtttnttcagtctagggacggtcagttgttacaagttgggtatgacaacggacttcccgggtagaaacggggtcctaacttccaaccactactacccgaagaacaactaaacttacccgaaagtaaacaactaaagtagttaagttaaggggaaaacttaggaaaccaacggtaccctaaaggtcccgttaggaaccggtaacgtaccggggttaagtaacgtaacgttaacgtaagggttaaaccgggtaaagggggaaacgggggaaacccgaggggttaccggggttaaacgttaaccgtaacggttacctttaacccggtttacggacggttaccgggttcggggttaaccccgtaaccgggg

SEQ ID NO: 357635 - DNA, 783 bp, Homo sapiens
  misc_feature: GZ8MTXP01B3K3J.10.44.D11.1.454.CMB.2.raw
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (321)..(321): a, c, t, g, unknown or other
  misc_feature (321)..(321): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggagcgtggtccagccgtgggagtcacagagactctctgtgcagcctcgtggtcaccttnagtanctacggcatcgacacgtcgggcccacaagcctccgaggcgaaaggggtnttggggaggtgggggtgctaggttttcgtttacagttccgtagggacggggtcctaaggtttgttacgaaagtttggggtaactcggactaacgggtacccgtttccccggggaagggaaaccgggggtcccctaaattacccgtaacccgtaacttaccgtacccgaaaggaaaccggtaaacctaaacgtttacccgaaaacgggtaaacctaaaccgttaaagttaggtttaaacgttttaaaggggggaaaactttaacggaaaccgtaacggtaaccgttaaacggtcccgttaaggaacggtacgtaacgggttagtaacgtacgtaacggtaaggttaaacggggaaacggggacgggggaaaccgtaagggttacgggttaacgttaccgtaaacggttaccgttaaccgtttcggaccggttacgggtccggggttaacccgttaacccgggg

SEQ ID NO: 357636 - DNA, 686 bp, Homo sapiens
  misc_feature: GZ8MTXP01BEEGP.10.44.D11.1.454.CMB.2.raw
  modified_base (247)..(247): a, c, t, g, unknown or other
  misc_feature (247)..(247): n is a, c, g, or t
  modified_base (263)..(263): a, c, t, g, unknown or other
  misc_feature (263)..(263): n is a, c, g, or t
  modified_base (575)..(575): a, c, t, g, unknown or other
  misc_feature (575)..(575): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtacaaatgcaactggtggagtcgtgggggagcgtgtccagcctgggagtcacagagactctctgtgcngcctgtggtcaccttnagtagcacggcagtgctacgtcgggtcccaccaagcctaccgaaggcgaaggggtattcgggggagttcgggggtgcgttaggtttgtttaccgattccggtaggaacggggtcctaggttgtttaccgaaagttcgggtaatcgaccgtaaacgggtaccgttcccggaagggtaacccggggcctaactttaccgaaccctactccgtaccgaagaaccggaactaacgttaccaaggaaccacgtaaagtagttacgttaaggggaaacttgaaacctagtacctaaagcctaggacgtacgtacggtntaactacgtaacgtggaaacggtacggggacggggaacctacgggacggggttacttaccgtaagtcccgttcgttacggacggttacggtaacggggcccgttaaccggg

SEQ ID NO: 357637 - DNA, 638 bp, Homo sapiens
  misc_feature: GZ8MTXP01BVQ5W.10.44.D11.1.454.CMB.2.raw
  modified_base (169)..(169): a, c, t, g, unknown or other
  misc_feature (169)..(169): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (321)..(321): a, c, t, g, unknown or other
  misc_feature (321)..(321): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgcttcttttaagnggtgtccagtgtcaagtgcaacgtggtggagtcgtgggggagcgtggtccagccgtgggagtcacagagactctcctgtgcagcctcgtgggtcaccttnagtanctacggcatgcacgtcgggtcccncaagcctccgaggacgaaggggnttgggaggtggggtgctaggtttgttcagttcgtggacggggctaggttgttacaagttgggtaatcggcagtacgtcccgtaggaacggggcctattccgactatctaccagacgaacctattaccgaaggaacactaagttagttaagttaggggaaattgaaacctacgtacctaacgtccgtagaacgggacgtacgggtagtacttacgtaagtgggttaaacgggaaggggaacgggggtaaccgagggcgggttacgttaccgtaaggttaccttccggtttcggacgttcggtcggggcccgtaacggg

SEQ ID NO: 357638 - DNA, 665 bp, Homo sapiens
  misc_feature: GZ8MTXP01D24JX.10.44.D11.1.454.CMB.2.raw
  modified_base (169)..(169): a, c, t, g, unknown or other
  misc_feature (169)..(169): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (300)..(300): a, c, t, g, unknown or other
  misc_feature (300)..(300): n is a, c, g, or t
  modified_base (365)..(365): a, c, t, g, unknown or other
  misc_feature (365)..(365): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgctcttttaagnggtgtccagtgtcaagtgcaacgtggtggagtcgtgggggagcggtggtccagccgtggggagtcacagacgactctcctgtcgcagtcctgtgggttccacttnagtanctacggcatgcacgtgggccncaagcctcgaggcgaaagggattgggacggttgggtagcttaggtttgttacagtcgtggacggntagtgtacagtgatgcagaccgttcgagaacggggtctataccactatcgacagacgtaaccagttaccgaacgaccaaagtaagttatttaagggttaagggtaaaacgttacgaaaccggtataacccgttaacggtcgttaggaaacgggaacgttacggggtaacgttaataacgtaaaccgtaggggaaccggaaacgggggacggggtaaaccgtagggacccggggttaacgttacgaacttcccgtttaacgtcggtaccgggttccgggttaaccgggccggtaacccggg

SEQ ID NO: 357639 - DNA, 503 bp, Homo sapiens
  misc_feature: GZ8MTXP02G2OBZ.10.44.D11.1.454.CMB.2.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
  modified_base (287)..(287): a, c, t, g, unknown or other
  misc_feature (287)..(287): n is a, c, g, or t
  modified_base (382)..(382): a, c, t, g, unknown or other
  misc_feature (382)..(382): n is a, c, g, or t
  modified_base (412)..(412): a, c, t, g, unknown or other
  misc_feature (412)..(412): n is a, c, g, or t
tcagcatagtagtgcacgaccggtgctcgatttagcgcagtacgaagggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgttggcncctagtagcctggtaccaacagaaacctggccaggctcccaggcccctnactctatggtgcatccaacagggccatggcatcccagccagttcagtggccagtggtctgggacagacttcactctcaccatcatcagcctggancctgaagatgtgctagttatactgtcaacntcgtacgagtcgccgtccggggcctacgttcggccctgggaccaaaggtcgatatacaaacgactgtacgctgcacatctgtctcacttcc

SEQ ID NO: 357640 - DNA, 536 bp, Homo sapiens
  misc_feature: GZ8MTXP02I1DX9.10.44.D11.1.454.CMB.2.raw
  modified_base (291)..(291): a, c, t, g, unknown or other
  misc_feature (291)..(291): n is a, c, g, or t
  modified_base (369)..(369): a, c, t, g, unknown or other
  misc_feature (369)..(369): n is a, c, g, or t
  modified_base (385)..(385): a, c, t, g, unknown or other
  misc_feature (385)..(385): n is a, c, g, or t
  modified_base (402)..(402): a, c, t, g, unknown or other
  misc_feature (402)..(402): n is a, c, g, or t
tcagcatagtagtgcacgaccggtgctcgatttagcgcagtacgaagggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagacgtggtccagcctgggaggtcacagagactctcctgtgcagcctctgggttcaccttcagtagctacggcatgcactgggtccnccaagctccaggcaaggggattggagtggggtggcagttgttcatctgagggcagtgttcaatggtatgcagactcgngaaggccatcacatcncagagacatcagaacanatgtattaggaaatgaacagacctaagtcctagaggacacgggtagtatactacgtaggtaacggaagggaacgggggaaccaggacgggagttaccgaagtactacgttacgacgtcgtcgggaccgtacggg

SEQ ID NO: 357641 - DNA, 600 bp, Homo sapiens
  misc_feature: GZ8MTXP02IJARZ.10.44.D11.1.454.CMB.2.raw
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (389)..(389): a, c, t, g, unknown or other
  misc_feature (389)..(389): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggagtcacagagactctcctgtgcagcctgtgggttcaccttcagtagctacggcatgcacgtggtccncaagcctcgaggcaagggnttggagtggtgctagttgttcagtcgtgacgggctagtgtacaagtggtatgcagtctcgtagaacggcctatcacatcnccagacgactaattccaaggaactacaagtgtattagaaattgaactagacctaagtcctaggaacgtacgacgggtataacgtacgttacgtacggtacggaaacgggtacgggggaaacccgtagggtaccgggtaacgttacccgtaaacggttaccgttaccgtttacggaaccggttccggtaccgggggtaccttaacccggggg

SEQ ID NO: 357642 - DNA, 620 bp, Homo sapiens
  misc_feature: GZ8MTXP02JGT6C.10.44.D11.1.454.CMB.2.raw
  modified_base (292)..(292): a, c, t, g, unknown or other
  misc_feature (292)..(292): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctctgggttcaccttcagtagctacggcatgcacgtgggtccnccaagcctccgaggcaaggggtattgggaggtggggtggctaggtttgtttcagtcgtggacggggctaggttgttacaagtggtaatggcaaggccgtccgtaggaacggggcctattaccgacctactcctaccgagaacgactaacttaccgaaggaacacaagttagtattaggaaatagaacacggtacctaacgtcctaggacggacgacgggtagtaatacgtaacgtaggtaaacggaacggggaacgggggaacacgggacgggtacgtaccgaagttacgtacgtttacggacgtcggtacggggaccgtaaccgggg

SEQ ID NO: 357643 - DNA, 559 bp, Homo sapiens
  misc_feature: GZ8MTXP02IIWX9.10.44.D11.1.454.CMB.2.raw
  modified_base (292)..(292): a, c, t, g, unknown or other
  misc_feature (292)..(292): n is a, c, g, or t
  modified_base (314)..(314): a, c, t, g, unknown or other
  misc_feature (314)..(314): n is a, c, g, or t
  modified_base (386)..(386): a, c, t, g, unknown or other
  misc_feature (386)..(386): n is a, c, g, or t
tcagcatagtagtgcacgaccggtgctcgatttagcgcagtacgaaggggggagatgagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctctggttcaccttcagtagctacggcatgcacgtgggtcccnccaagctccgaggcaaaggggnttgggagtggggtgctagtttgttcagtctggagggctagtgttcaagttgggtatgacaggtacctccggnggaaacgggccgtattcaccatctccagagacaattaccgagaacacaatgtaatttaggaaatgaacagtacctaagtcctagaggacgacggtagtaactacgtacgtagtacggaaagggacgggggaacgacggcggagtcgaagtactcttagacgtcgtcgggaccg

SEQ ID NO: 357644 - DNA, 544 bp, Homo sapiens
  misc_feature: GZ8MTXP02F38ZB.10.44.D11.1.454.CMB.2.raw
  modified_base (292)..(292): a, c, t, g, unknown or other
  misc_feature (292)..(292): n is a, c, g, or t
  modified_base (313)..(313): a, c, t, g, unknown or other
  misc_feature (313)..(313): n is a, c, g, or t
tcagcatagtagtgcacgaccggtgctcgatttagcgcagtacgaagggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcctgtgcagcctctgggtcaccttcagtagctacggcatgcactgggtcccnccaagcctccaggcaaggggnttgggagtggggtggcaggtttgttcatctggagggcagtgttcaagtggtatgcagactccgtgaagggccattcaccatctccagagacaactccaagaacacaatagtattaggaaatgaacagacctaagcctagaggacacgggtagtatactacgtaggtaacggaagggagggggaccaggacggagttaccgaagtactcgttcgacgtcgtcgggctacggg

SEQ ID NO: 357645 - DNA, 556 bp, Homo sapiens
  misc_feature: GZ8MTXP02JN1IK.10.44.D11.1.454.CMB.2.raw
  modified_base (294)..(294): a, c, t, g, unknown or other
  misc_feature (294)..(294): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcctgtgcagccctcgtgggttcaccttcagtagctacggcatgcacgtgggtccnccaagcctccgaggcgaaggggattgggagtggggtgctagttgttcatcgtggacgggctagtgttcaagtggtatgacagactccgtagaacggcattcacatctcagagacactcaagaacacaatgtattaggaaatgaacagacctaagccgtagagacacgggtatatactacgtgtaacgggaagggacgggggaacacggacgggtacgttacgaacgtcgttacgttacgacgtcgacggggacctaccgggg

SEQ ID NO: 357646 - DNA, 669 bp, Homo sapiens
  misc_feature: GZ8MTXP02H3EQ1.10.44.D11.1.454.CMB.2.raw
  modified_base (292)..(292): a, c, t, g, unknown or other
  misc_feature (292)..(292): n is a, c, g, or t
tcagcatagtagtgcacgaccggtgctcgatttagcgcagtacgaagggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcctgtgcagcctctgggttcaccttcagtagctacggcatgcacgtgggtccnccaagcctccaggcaagggattggagtgggtgctagttgttcatcgtggacgggcagtgttcaaagttgggtaatgctaagaccgttccggtagaaacgggggcctattccaacccatcctccaagacgactaaacgttccgaaggaaccactaaatagttaatttagggaaaattagaaacacgtacccgtaaagtacccgtaggaacgggacgtacggggttagtaacgtaaccgttaacgtaacgggttaaccgggaaaaggggtaacggggggaaacccgaaggggaccggggtaacgtttacccgaaaacggttaccgtttacccggtttacggtaccggttaccggtacgggggtacccgtaacccggggg

SEQ ID NO: 357647 - DNA, 524 bp, Homo sapiens
  misc_feature: GZ8MTXP02FP6D5.10.44.D11.1.454.CMB.2.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
tcagcatagtagtgcacgaccggtgctcgatttagcgcagtacgaaggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctntcctgcagggccagtcagagtgttggcgcctacgtagcctggtaccaacagaacctggccaggcctcccgaggccccctnactctatggtncatccaacgngggcccagtggcactcccagccaggttcaggtggccaggtcgggtctggggacagacttcactctcaccatcatcacgcctggacgctgaagatgtgctagtttattactgtacaactatcgtacgagtcggccgtccggggcctacgttcggccgtcggacaaggtcgatatacaaacgactcgtcgctcgcacgatctcgtctcacttccg

SEQ ID NO: 357648 - DNA, 710 bp, Homo sapiens
  misc_feature: GZ8MTXP02GO2BG.10.44.D11.1.454.CMB.2.raw
  modified_base (296)..(296): a, c, t, g, unknown or other
  misc_feature (296)..(296): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggagtcacagagactctcctgtgcagccctgtgggttcaccttcagtacgctacggcatgcacgtgggtcccnccaagcctccgaggcaaggggattgggaggtggggtggctaggtttgttcatcgtggacggggcaggttgttcaagttggtatggcaggtactccgtaggaacggggccgtaattccacctatccgtaccgagaacgactaacgttaccgaaggaaactacaaagttagttaagtttagggaaattacgaaacgtaacgtaccctaaacggttaccgtagggtaacggaaccgtacgggggttagtaacgttaaccgttaacggttacgggttaacggggaaacgggggtaacgggggggaaacccgaacgggggtaccggggttaaccgggtttacccgtaaacggtttacccgtttacccgttttacgggaacccggtttcggttaccgggggtacccggttaacccggggg

SEQ ID NO: 357649 - DNA, 510 bp, Homo sapiens
  misc_feature: GZ8MTXP02J0YIW.10.44.D11.1.454.CMB.2.raw
  modified_base (200)..(200): a, c, t, g, unknown or other
  misc_feature (200)..(200): n is a, c, g, or t
  modified_base (254)..(254): a, c, t, g, unknown or other
  misc_feature (254)..(254): n is a, c, g, or t
  modified_base (284)..(284): a, c, t, g, unknown or other
  misc_feature (284)..(284): n is a, c, g, or t
  modified_base (304)..(304): a, c, t, g, unknown or other
  misc_feature (304)..(304): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (410)..(410): a, c, t, g, unknown or other
  misc_feature (410)..(410): n is a, c, g, or t
tcagcatagtagtgcacgaccggtgctcgatttagcgcagtacgaaggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccacctctcctgcagggccagtcagagtgttgcgctagtagcctggtaccaanagaaacctggccaggctcccaggccccctnatctatggtgcatccaaacngggcccacgtggcatcccagccaggttcagtggcagtggctgggacagactcactctcacntcatcanctgagcctgaagatgttgactagtttattactgtacanatcgtaccgagtggccgtccggggctacgttcggccgtcggaccaagtcggactatacaaacgtacgtgtacgctgctaccgactctgtcttcacttccg

SEQ ID NO: 357650 - DNA, 564 bp, Homo sapiens
  misc_feature: GZ8MTXP02H8WT9.10.44.D11.1.454.CMB.2.raw
  modified_base (292)..(292): a, c, t, g, unknown or other
  misc_feature (292)..(292): n is a, c, g, or t
  modified_base (362)..(362): a, c, t, g, unknown or other
  misc_feature (362)..(362): n is a, c, g, or t
tcagcatagtagtgcacgaccggtgctcgatttagcgcagtacgaagggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctactgcatgcactgggtcccncaagctccaggcaagggattgggagtggggtgcagttgtttcatcgtgaggggcagtgttcaattgggtntgcaagactccggtgaaaggggcccgattcaccatctccagacgacaattccaagaacacaaatgttaatttaggaaatagaaacagaccctaagtacctagaggacacgggtagtatactactagtaacggaaagggaacgggggaaccgaggacgggaagttccgaaagtactaccgtttagacgttcgtacggggaccg

SEQ ID NO: 357651 - DNA, 557 bp, Homo sapiens
  misc_feature: GZ8MTXP02F2GOC.10.44.D11.1.454.CMB.2.raw
  modified_base (291)..(291): a, c, t, g, unknown or other
  misc_feature (291)..(291): n is a, c, g, or t
tcagcatagtagtgcacgaccggtgctcgatttagcgcagtacgaagggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcctgtgcagcctctgggtcaccttcagtagctacggcatgcacgtgggtccnccaagcctccgaggcaaggggattgggagtggggtggctaggtttgttcatcgtggacggggcaggtgttacaagttggtatggcagtactccgtgaacgggccattcacatctcagagacaattcaagaacacaatagtattagaaatgaacagacctaagtcctagaggacgacgggtagtatacgtactaggtaacggaagggaagggggaaccgaggacgggagtacgaagtactacgttagacgtcgtcgggacgtacggg

SEQ ID NO: 357652 - DNA, 609 bp, Homo sapiens
  misc_feature: GZ8MTXP02GIVEZ.10.44.D11.1.454.CMB.2.raw
  modified_base (295)..(295): a, c, t, g, unknown or other
  misc_feature (295)..(295): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggagtcacagagactctcctgtgcagcctcgtgggttcaccttcagtagctacggcatgcacgtgggtccncaagctccgaggcaagggattgggaggtggggtgcgtagtttgtttcagtctggacgggcaggtgttacaagtggtatgcaggtaccgtccggtgaaacggggccattcacctactctaccagaacgacaacttaccgaaggaaacacaatagtaattaggaaatagaacacgacctaaacgtccgtagacggaacgtacgggtagtacgtaacgtacgtacggtaacggaacggggaacgggggaaccgacgggacgggtacgtaccgaacgtacgttcgttacggacgtacggtacggggaccgtaacgggg

SEQ ID NO: 357653 - DNA, 732 bp, Homo sapiens
  misc_feature: GZ8MTXP02HG41L.10.44.D11.1.454.CMB.2.raw
  modified_base (295)..(295): a, c, t, g, unknown or other
  misc_feature (295)..(295): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcctgtgcagcctctgggttcaccttcagtagctacggcatgcacgtcgggtccnccaagcctccgaggcaaggggattgggaggtgggtggctaggtttgtttcatcgtgacggggcaggttgttacaagttggtatggcaaggtaccttccggtaggaaacggggccctagttaccgaccctagtacctacccgagaacgaactaacgttacccaaacggaaaccactaaagttaggttaagttttaagggaaaattacggaaactaacggtaacccgttaaacggttacccgtagggaacgggtaacgtaaccgggggttaagttaaacgttaaccgttaacgttacgggttaaaccggggaaaacgggggtaaacggggggaaacccggtaacggggaccggggtaacggtttaacccggtaaacggttacccgtttaccggtttacggtaacccggttccggtacgggggtacccgttaaccggggg

SEQ ID NO: 357654 - DNA, 581 bp, Homo sapiens
  misc_feature: GZ8MTXP02IPPN8.10.44.D11.1.454.CMB.2.raw
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcctgtgcagcctctgggttcaccttcagtagctacggcatgcacgtgggtcccnccaagcctccaggcaagggnttgggagtggggtgcgtagtttgtttcatcgtggacgggctagtgttacaagtggtatgcagtacctccggtagacgggcctattccaccatctcagacgacaacttccaagaacacaatgtaattaggaaatagaacagacctaagtcctagacggacgtacggtatatactacgtagtaacggaacgggacggggaaacacgggacgggtacgttaccgaagtacgtaccgttacggacgtcgtacggggtaccgtaccgggg

SEQ ID NO: 357655 - DNA, 557 bp, Homo sapiens
  misc_feature: GZ8MTXP02F2ERD.10.44.D11.1.454.CMB.2.raw
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (271)..(273): a, c, t, g, unknown or other
  misc_feature (271)..(273): n is a, c, g, or t
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (309)..(309): a, c, t, g, unknown or other
  misc_feature (309)..(309): n is a, c, g, or t
  modified_base (331)..(331): a, c, t, g, unknown or other
  misc_feature (331)..(331): n is a, c, g, or t
  modified_base (348)..(348): a, c, t, g, unknown or other
  misc_feature (348)..(348): n is a, c, g, or t
  modified_base (364)..(364): a, c, t, g, unknown or other
  misc_feature (364)..(364): n is a, c, g, or t
tcagcatagtagtgcacgaccggtgctcgatttagcgcagtacgaaggggaggaactgctcagttaggacccagagggaaccatggaagccccagctcagcttctcttcctcctgctactctggctcccagtttcagataccaccggagagattgtgttgacacagtctccagccaccctgtctttgtctccaggggaangccacctctcctgcagggccagtcagngtgtgcnctagngctgacanagactgcngcncagcctatcatgnnntcanggcntgcanccagcagtcagtgcctagtggtnggacagtctcactctaccactntcatcacgcgtaggacncgtagaagtactggtntacgttagtttatcttagtacaactacgtacgtaccgtaggtcggtcccggtcccgggggtaccttacgggtttcccggacccgttacggggaaaaccctaaagggtacgtagttaccgtaaacgtaaaacggtacgttggtacggtctacggtaaccgaacgttactcgttcgttctttacacgtttccccg

SEQ ID NO: 357656 - DNA, 646 bp, Homo sapiens
  misc_feature: GZ8MTXP02F0CRV.10.44.D11.1.454.CMB.2.raw
  modified_base (199)..(199): a, c, t, g, unknown or other
  misc_feature (199)..(199): n is a, c, g, or t
  modified_base (287)..(287): a, c, t, g, unknown or other
  misc_feature (287)..(287): n is a, c, g, or t
  modified_base (376)..(376): a, c, t, g, unknown or other
  misc_feature (376)..(376): n is a, c, g, or t
  modified_base (391)..(391): a, c, t, g, unknown or other
  misc_feature (391)..(391): n is a, c, g, or t
tcagcatagtagtgcacgaccggtgctcgatttagcgcagtacgaaggggaggaactgctcagttaggacccagagggaaccatggaagccccagctcagcttctcttcctcctgctactctggctcccagtttcagataccaccggagagattgtgttgacacagtctccagccaccctgtctttgctccaggggaanagccaccctctcctgcagggccagtcagagtgttggcgcctacgtagcctggtaccaacagaaacctggccaggctcccaggcccctnatctagtggtgcatccaacgagggccacgtggcactcccagccaggttcagtcggccagtgggtctggggacagacttcactctcaccntcatcacgctggacnccgtagaagtagtgttgactagtttacttacttagtactaaactacgttaccggtaaccgtaagggtcggtacccccggttcccgggggtacccttacccggtttcccggggaccccgttacgggggaaaccctaaaacgggttacgggtaaacgttaacgttaaccgaaaaaccggttaacgttcggtaacggggtccttaacggaaccgtaacctaacgttccgttacgtttctttacccgtactttcccccg

SEQ ID NO: 357657 - DNA, 538 bp, Homo sapiens
  misc_feature: GZ8MTXP02FX7BB.10.44.D11.1.454.CMB.2.raw
  modified_base (290)..(290): a, c, t, g, unknown or other
  misc_feature (290)..(290): n is a, c, g, or t
  modified_base (333)..(333): a, c, t, g, unknown or other
  misc_feature (333)..(333): n is a, c, g, or t
tcagcatagtagtgcacgaccggtgctcgatttagcgcagtacgaagggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcctgtgcagcctctgggttcaccttcagtagctacggcatgcactgggtccnccaagctccaggcaaggggattgggagtggggtggcaggtttnttcatctggagggcagtgttcaatggtatgcagactccgtgaagggccattcacatctcagagacattcagaacacaatagtattaggaaatagaacagactaagtcctagaggacgacggtagtatactacgtagtacggaaagggagggggaacgaggacgggagtaccgaagtactcgttacgacgtcgtcgggcgtacggg

SEQ ID NO: 357658 - DNA, 644 bp, Homo sapiens
  misc_feature: GZ8MTXP02GFUFE.10.44.D11.1.454.CMB.2.raw
  modified_base (268)..(268): a, c, t, g, unknown or other
  misc_feature (268)..(268): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcctgtgcagcctcgtgggttcaccttnagtagctacggcatgcactggggtcccnccaagctccgaggcaagggnttgggagtggggtggctagtttgttcatcgtggagggctaggtgttacaagttggtatggacaggaccttccgggtagaaacggggtcccgtattaccaacctaacgttcctaccgaagaacgaacctaaacttacccgaaaggaaaccaactaataggttaatttaggaaattagaaacagacctaagtccgtaggacggacacgggtatacgtacgtacgtaggtaacggaaggggtaacgggggaaccacggggacgggtaacgttaccgtaaaggttaccgtaccgtttacggaccggttcggtacgggggaccgtaaccgggg

SEQ ID NO: 357659 - DNA, 552 bp, Homo sapiens
  misc_feature: GZ8MTXP02GTRAR.10.44.D11.1.454.CMB.2.raw
  modified_base (252)..(252): a, c, t, g, unknown or other
  misc_feature (252)..(252): n is a, c, g, or t
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctntgggttcaccttcagtagctacggcatgcactgggtccnccaagctccaggcaagggnttggagtgggtgctagttgttcatctgaggcagtgttcaatggtatgcagactccgtgaaggccgatcacatctccagagacaatcaagaacacaatgtatttaggaaatgaacagacctaagtcctaggagacgacgggtagtatactaacgtgtaacggaagggacgggggaaaccgagggacgggtaacgttaccgaacgtactacgttacggaccgtcgtacggggaccgtaacgggg

SEQ ID NO: 357660 - DNA, 555 bp, Homo sapiens
  misc_feature: GZ8MTXP02FT516.10.44.D11.1.454.CMB.2.raw
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
  modified_base (323)..(323): a, c, t, g, unknown or other
  misc_feature (323)..(323): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcctgtgcagcctctgggttcaccttcagtagctacggcatgcacgtgggtccncaagcnccgaggcaagggntggagtggggngctaggtttgttcatcgtggacggggctaggtgttcaagtggtatgcagactccgtgaagggccatcacatctcagagacaacttacaagaacacaatagtaattagaaatagaacagacctaacgtcctagaggacgacggtagtatactacgtaggtaacggaagggacgggggaacgacggacgggacgtacgaacgtacgtacgttcgacgtcggtcggacgtacggg

SEQ ID NO: 357661 - DNA, 712 bp, Homo sapiens
  misc_feature: GZ8MTXP02ITBJI.10.44.D11.1.454.CMB.2.raw
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggaggcgtggtccagccgtgggaggtcacagagactctcctgtgcagcctcgtgggttcaccttcagtgctacggcatgcacgtggtcccaccaagcctcgaggcgaagggattggaggtgggtaggctaggtttgtttcatcgtggacggtctaggttcgttacaaagttgggttaatcgacgtaacggtacccgttccggggtaagggaaacgggggccccttaaagttacccgaaccctaacgttccctacccgaaggaaacgtaaacctaaacgttacccgaaaggaaaacctaaacgtaaagttacggttaaattttaagggaaaaattacggaaaacaacggtaacccgttaaaagtcccgtaaggaacggtacgtaacggggttataactaacgttaacgtaggtaacgggaaacggggaaacgggggtaacgacgggtacgggtaacgttaccgaacgttactcggtttacgaccgtacggtcggggaccgtaaccggg

SEQ ID NO: 357662 - DNA, 565 bp, Homo sapiens
  misc_feature: GZ8MTXP02II8KG.10.44.D11.1.454.CMB.2.raw
  modified_base (264)..(264): a, c, t, g, unknown or other
  misc_feature (264)..(264): n is a, c, g, or t
  modified_base (311)..(311): a, c, t, g, unknown or other
  misc_feature (311)..(311): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggagtcacagagactctcctgtgcagcctgtggtcaccttnagtgctacggcatgcacgtgggtcccaccaagcctcgaggcaagggnttgggagtgggtgctagttgttcagtcgtggagggctagtgttacaagttggtatggcagaccgttccgtagaacgggcctagttcacatctccagacgacaacttccaagaacacatagttaattagaaatagaacagactaagtctagagacgaggtatatactacgtaggtaaggaagggaacggggaacgacggacggtacgtacgaagttaccgttacgtttacgacgtcggtacgggaccgtacgggg

SEQ ID NO: 357663 - DNA, 530 bp, Homo sapiens
  misc_feature: GZ8MTXP02IXV2Q.10.44.D11.1.454.CMB.2.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
tcagcatagtagtgcacgaccggtgctcgatttagcgcagtacgaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagagtgttggcgcctagtagcctggtaccaacagaaacctggccaggcctcccaggcccctnatctatggtncatcccaacgagggcccacgtggcactcccagccaggttcagtgccagtggtctgggacaggacttcactctcaccatcatcagcctggacgcctagaagtattgttgctagtttacttactagtacaactattacgtaccgaggtcggccgtccgggggcctacgttcggcctggaccaagtcgatatacgaaacgactgtacgctgcacactctgtcttacacttccc

SEQ ID NO: 357664 - DNA, 536 bp, Homo sapiens
  misc_feature: GZ8MTXP02IL232.10.44.D11.1.454.CMB.2.raw
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (426)..(426): a, c, t, g, unknown or other
  misc_feature (426)..(426): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggtttcctcgttgctcttttaagaggtgtccagtgtcaagtgcaactggtggagtcgtggggggaggcgtgggtccagcctgggaggtcacagagactctcctgtgcagcctctgggttcaccttcagtagctacggcatgcacgtgggtccnccaagcctcgaggcaagggntgggagtggggtgctagtttgttcatcgtggagggcagttgttacaattggtatggcagtacctccgtagaaggggccattccactatctacagagacattccagaacanatgtattaggaatgaacagacctagtctagagacaggtatatactacgtagacggagggacgggacagacggatacgaagtactcgttacgacgtcgtcgggacctacgg

SEQ ID NO: 357665 - DNA, 674 bp, Homo sapiens
  misc_feature: GZ8MTXP02H5HYV.10.44.D11.1.454.CMB.2.raw
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaaatgcaactggtggagtctgggggagcgtggtccagcctgggaggtcacagagactctcctgtgcagcctctgggttcaccttcagtagctacggcatgccacgtgggtccgccaagctccaggcaagggattggagtggggtgctagtttgttcatcgtggacgggcagttgttcaagttgggtatggcagaccgttccggtagaacggggccctaattccacctactcctacccgaagacgactaacttacccgaaggaaaccaacctaaagttagttaaacgtttaagggaaaattagaaacacggtaccctaaaaggttaccgtaggacgggaacgtaacggggttagttaaacgtaaccgttaaccgttaggtaaaccggaaacgggggaaacggggggaaacccgacgggacggggtaacgttacccgtaaagttacccgttaccgtttacggtaccggttccggtacggggtacccgtaaccgggg

SEQ ID NO: 357666 - DNA, 536 bp, Homo sapiens
  misc_feature: GZ8MTXP02HE4AK.10.44.D11.1.454.CMB.2.raw
  modified_base (251)..(251): a, c, t, g, unknown or other
  misc_feature (251)..(251): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
tcagcatagtagtgcacgaccggtgctcgatttagcgcagtacgaaggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctntgggttcaccttcagtagctacggcatgcactgggtccnccaagctccgaggcaagggnttggagtggggtgcagttgttcagtctggacgggcagtgtacaatggtactgcagactccgtagaaggcctattcaccatcctacagaagacaattccaaggaacacaatgtattaggaaatagaacagtcctaaacgtccgtagaggacacgggtagtatactacgtgtacggaaggacggggacagcggagtacaagtctacgtgacgcgtcgggtactacggg

SEQ ID NO: 357667 - DNA, 651 bp, Homo sapiens
  misc_feature: GZ8MTXP02JSXFL.10.44.D11.1.454.CMB.2.raw
  modified_base (298)..(298): a, c, t, g, unknown or other
  misc_feature (298)..(298): n is a, c, g, or t
  modified_base (323)..(323): a, c, t, g, unknown or other
  misc_feature (323)..(323): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccaggcctggggaggtcacagagactctcctgtgcagcctcgtgggttcaccttcagtagctacggcatgcacgtcgggtccnccaagcctaccgaggcgaaggggtnttgggaggtggggtggctagttgttcatcgtggacgggctagtgtttacaagtggtatcggcagaccgtccggtaggaacggggtcctagttaccaccgtactccgtaccgagaacgactaacgttacccgaaaggtaacaactaaagtgttaaatttagggaaatcgaacacgtacctaagtccgtaggaacggtacggacgggttataacgtacgtacgtaaggtaacggaaacgggggaacgggggaaccgaggaccggggtaacgttaccgtaacggttaccgttcgttacggtacggtccggtacggggtaccggaaccgggg

SEQ ID NO: 357668 - DNA, 647 bp, Homo sapiens
  misc_feature: GZ8MTXP02F233H.10.44.D11.1.454.CMB.2.raw
  modified_base (294)..(294): a, c, t, g, unknown or other
  misc_feature (294)..(294): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctcgtgggttcaccttcagtagctacggcatgcacgtgggtcccnccaagcctccgagggacaaggggattgggagtggggtgctaggtttgttcagtcgtggacgggtctagttgttacaagttggtatggacaaggtaccttcccgggtaggaaacggggccctaattaccacctactccgtaccagaagtacaaacttaccgaaaggaaaccaactaaagttagttaaagtttaggaaaattagaaacacggtacctaaacgtcctaggaacggacgtacgggtagtaacgtactaacgtaggtaaacggaaaggggtaacgggggaaccgaggacgggtacgtaaccgtaagttacgttaccgtttagacggtcgtacggggaccgtaccgggg

SEQ ID NO: 357669 - DNA, 615 bp, Homo sapiens
  misc_feature: GZ8MTXP02HLCOO.10.44.D11.1.454.CMB.2.raw
  modified_base (295)..(295): a, c, t, g, unknown or other
  misc_feature (295)..(295): n is a, c, g, or t
  modified_base (367)..(367): a, c, t, g, unknown or other
  misc_feature (367)..(367): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcctgtgcagcctcgtgggttcaccttcagtagctacggcatgcacgtgggtccnccaagctccgaggcaagggattggagtgggtggctagtttgttcatcgtggagggcagtgttcaagtggtangcagactcgtgaacggctatcaccatctaccagacgaacaacttaccgaagaacaactaagttgttaacttttaaggaaaacttagaaacacgtaaccgtaacgtcgtaggaacggtacgtacgggttagtacgtaccgtacgtacggtaaacgggaaacgggggtaaacggggacgacgggtacgggtaacgtaccgtaaacgttccgttacgttacggtacggtccggtcgggaccggttaccggg

SEQ ID NO: 357670 - DNA, 611 bp, Homo sapiens
  misc_feature: GZ8MTXP02JNP5L.10.44.D11.1.454.CMB.2.raw
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggagtcacagagactctcctgtgcagcctctgggttcaccttcagtagctacggcatcgcacgtcgggtcccgccgaagcctacccgaggcgaaggggattgggaggtggggtggcgtagtttgttcatcgtgacggggcagtgttacaagtggtatggacagacgtccggtaggaacgggccgtattccacctactctccagacgacaactaccaagaacactaatagttagttaggtaatagaacagacctaagtcctagacggacgacgggtagtatactacgtacggtaacggaacggggaacgggggaacgacgggtacgggtaacggttaccgaaggtaccgttaccgttacggtaccggtacggtcggggacgtaccgggg

SEQ ID NO: 357671 - DNA, 784 bp, Homo sapiens
  misc_feature: GZ8MTXP02HLP9I.10.44.D11.1.454.CMB.2.raw
  modified_base (167)..(167): a, c, t, g, unknown or other
  misc_feature (167)..(167): n is a, c, g, or t
  modified_base (294)..(294): a, c, t, g, unknown or other
  misc_feature (294)..(294): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagnggtgtccagtgtcaagtgcaactggtggagtcgtgggggagcgtggtccagcctgggagtcacagagactctcctgtcgcagcctcgtgggttcaccttcagtagctacggcatgcacgtcggtccnccaagcctccgaggcaagggattggagtgggtgctagtttgtttacagttcgtaggacggggtctaggttcgttacgtaaagttggggttaatcggaccgtaaacggtacccgttacccggggttaaggggaaaccgggggtccccttaaagtttaccccgaaaccctaacgttcccgttaacccgaaaggtaaccgtaaaccgtaaaccgtttacccgaaacgggtaaaacctaaacgtaaagttacggtttaaagtttaagggaaaactttacggaaaactacggtaacccgttaacggtaccgttaagggaacggtacgtaacgggttagtaaacgtacgttaacgtacgggtaaacggggaaacgggggtaacgggggtaaaccgtacgggggtaaccgggtaacggtttaacccgtaacggttaacccgttaccggtttacgggaaccggttaccgggtaccgggggtacccgttaacccggggg

SEQ ID NO: 357672 - DNA, 549 bp, Homo sapiens
  misc_feature: GZ8MTXP02JR24F.10.44.D11.1.454.CMB.2.raw
  modified_base (294)..(294): a, c, t, g, unknown or other
  misc_feature (294)..(294): n is a, c, g, or t
  modified_base (403)..(403): a, c, t, g, unknown or other
  misc_feature (403)..(403): n is a, c, g, or t
  modified_base (463)..(463): a, c, t, g, unknown or other
  misc_feature (463)..(463): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctcgtgggttcaccttcagtagctacggcatgcacgtcgggtccnccaagcctccgaggcaaggggattgggaggtggggtggctaggtttgtttcagtcgtggacggggctagtgtacagtggtatgcagactcgagaacggctatcacatcncagagacatcagacacaatgtattagaaatgaacagactaagtccgtagaggacagggtntatacgtacgtaggtacggaacgggacggggaacagggacggtacgtacgaagtacgtcgttacgacgtcgtcggggactaccggg

SEQ ID NO: 357673 - DNA, 582 bp, Homo sapiens
  misc_feature: GZ8MTXP02J2MJ7.10.44.D11.1.454.CMB.2.raw
  modified_base (293)..(293): a, c, t, g, unknown or other
  misc_feature (293)..(293): n is a, c, g, or t
  modified_base (367)..(367): a, c, t, g, unknown or other
  misc_feature (367)..(367): n is a, c, g, or t
  modified_base (400)..(400): a, c, t, g, unknown or other
  misc_feature (400)..(400): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcctgtgcagcctctgggttcaccttcagtagctacggcatgcacgtgggtccnccaagctccaggcaagggattggagtggggtgctagttgtttcatcgtgagggcagtgttacaagtggtatggnagactccggagaaggggccatcaccatctcagngacatccagaacanaatntattaggaaatgaaacagacctaaagtcctaggaacggacgaacggggtataactaacgtacgtaggtaaaccgggaaagggggaacgggggaaacccagggaccgggtacgttaccgaagttaaccgtccgttacggacgtcgtacgggggaccctaacgggg

SEQ ID NO: 357674 - DNA, 610 bp, Homo sapiens
  misc_feature: GZ8MTXP02J1XCY.10.44.D11.1.454.CMB.2.raw
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctggggaggtcacgagagactctcctgtgcagcctcgtggggttcaccttcagtagctacggcatgcacgtggggtcccnccaagctccgaggcaagggnttggagtggggtgctagttgttcatcgtggacgggctaggtgttacaagtggtatgcaggtacctccggtagaacgggcctagttccaccatcctaccgagacgactaattcccgaaggaaccactaatagttaattagggaaactgaaacaggtaccctaagtccgtagaacggtacgacggggtagtaactacgttacgtaggtaaaccggaaagggggacgggggaaaccagggacgggtaacgtaccgaagtcctacgttacgacggttcgtcggggacctacgggg

SEQ ID NO: 357675 - DNA, 644 bp, Homo sapiens
  misc_feature: GZ8MTXP02F3REQ.10.44.D11.1.454.CMB.2.raw
  modified_base (268)..(268): a, c, t, g, unknown or other
  misc_feature (268)..(268): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggaggcgtggtccagcctgggagtcacagagactctcctgtgcagcctcgtgggtcaccttnagtagctacggcatcgcacgtgggtcccacaagcctccgaggcaaggggtatgggaggtggggtgctaggtttgtttcagttcgtggacggggtctaggttgttacaagtggtaatggacagtaccgtccggtggaaacgggcctaattccacctatcctaccagagaacaacttacgaaggaaacaacgaattagttaagttaaggaaaacttagaaactaacggtaacctaaacgtccgtaggaacggaacgtacgggttaagtaactaacgtaacgtacggtaaacggaaggggaaacgggggaaacacgggacgggtacgtaccgaaagttaccttacgttacggacgtacggtacggggaccgtaaccggg

SEQ ID NO: 357676 - DNA, 619 bp, Homo sapiens
  misc_feature: GZ8MTXP02GQ79L.10.44.D11.1.454.CMB.2.raw
  modified_base (299)..(299): a, c, t, g, unknown or other
  misc_feature (299)..(299): n is a, c, g, or t
  modified_base (324)..(324): a, c, t, g, unknown or other
  misc_feature (324)..(324): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcctgtgcagcctcgtgggttcaccttcagtagctacggcatgcacgtcggggtcccnccaagcctccgaggacgaaggggtnttgggaggtggggtgcgtaggtttgtttcagtcgtggacgggctagttgtacaagtggtatgacagtctccggtagaacgggcctatccacatcacagacgacactccaagaacacatagtattaggaatagaacagactaagtcgtaggacggaacgtacgggtataacgtacgtacgtacggtaaacgggaaacggggaacgggggaaaccgacggggtaccgggtaacgttaaccgtaaagttaccgttaccgttacggaccggttcggtacggggtacccgtaacccgggg

SEQ ID NO: 357677 - DNA, 743 bp, Homo sapiens
  misc_feature: GZ8MTXP02IG0ZB.10.44.D11.1.454.CMB.2.raw
  modified_base (326)..(326): a, c, t, g, unknown or other
  misc_feature (326)..(326): n is a, c, g, or t
  modified_base (364)..(364): a, c, t, g, unknown or other
  misc_feature (364)..(364): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggagtcacgagagactctcctgtgcagcctcgtgggttccaccttcagtagctacggcatcgcacgtcgggtccaccaagcctaccgaggacaaaggggtnttgggaggtggggtggacttaggtttgtttcagttcgnggacgggctaggtgttacaagttggtaatcgacaagtaccgtacccggtagggaacggggtacctacgttaccaaccgtactacctacaacggtaacgtaaactaaaccgttaccgaaacggtaaacctaaacgtaaagttacgtttaaagtttaaacggaaaagttacgaaaaccgtaacggtaaccgttaaacggtacccgttaggaaacggtaaccgtaacggggttacgttaaacgttaaccgttaacggttaacggttaaacggggaaacggggaaacgggggaaaccgacggggtaccgggtaacgttaaccgtaaacgttaccgttaccgtttacggaccggttaccggtacggggtacccggtaaccgggg

SEQ ID NO: 357678 - DNA, 711 bp, Homo sapiens
  misc_feature: GZ8MTXP02F29IK.10.44.D11.1.454.CMB.2.raw
  modified_base (316)..(316): a, c, t, g, unknown or other
  misc_feature (316)..(316): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctctgtgcagcctcgtgggttcaccttcagtagctacggcatgcacgtgggtcccacaagctccgaggcgaagggtnttggaggtggggtggctaggtttgtttcagttcgtggacggggtctagttgttacaagttggtaatgacaggaccttccgggtaggaacggggtccctattaccacctactccgtacccgaggaacgaacctaaacttacccgaaaggaaacccaaactaagttaggttaaagtttaaggaaaacgttaggaaaacctaacggtacccgtaaacggtaccgtaagggaacgggtaaacggtacggggttaagtaacgttaaccgtaacggttacgggtaaacggggaaacgggggtaaacggggggaaacccgtaagggaccggggtacgttaaccgaaacggttaccgttaccgtttacggacggttacggtacgggggacccggtaaccgggg

SEQ ID NO: 357679 - DNA, 752 bp, Homo sapiens
  misc_feature: GZ8MTXP02F2JI7.10.44.D11.1.454.CMB.2.raw
  modified_base (300)..(300): a, c, t, g, unknown or other
  misc_feature (300)..(300): n is a, c, g, or t
  modified_base (324)..(324): a, c, t, g, unknown or other
  misc_feature (324)..(324): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggaggcgtggtccagcctgggagtcacagagactctcctgtgcagcctcgtgggtccaccttcagtagctacggcatgcacgtcgggtcccnccaagcctccgaggcgaaggggtnttgggaggtggggtggctaggttttgttcagttcgtggacgggctaggttcgttacaagtggtaatcggactaaggtacccgttaccgggtagggaaacgggggtccctaattacccgaacccgtactaccctaccgaaggaaacgtaaacctaaaccgttacccgaaacgggtaaacctaaactaaagtttaggtttaaagtttaaagggtaaaacttacggaaaaccgtaacggtaacccttaaacggtacccgtagggaaacgggtaacggtaacggggttataacgttaacgtaacggttaacgggtaaacgggaaacgggggaaacgggggaaaccgacggggtaccggggtaacgttaaccgaaacggttaccgttaccgtttacggaccggttcggtacgggggtacccgttaacccgggg

SEQ ID NO: 357680 - DNA, 535 bp, Homo sapiens
  misc_feature: GZ8MTXP02IZXXY.10.44.D11.1.454.CMB.2.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (301)..(301): a, c, t, g, unknown or other
  misc_feature (301)..(301): n is a, c, g, or t
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
tcagcatagtagtgcacgaccggtgctcgatttagcgcagtacgaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccacctctcctgcagggccagtcagagtgttggcgcctacgtagcctggtaccaanagaaacctggccaggcctcccaggcccctcatctatggtncatccaaagcgggcccagtggcactcccagcccaggttcagtggccaggtgggtctggggacaggacttcgactctcaccatcatcagcctgacgcgtagaagtatgttgcgtagtttatctagtacaanattcgtacgngtacgccgtccggggctacgttcggccgtagggaccaaagtggataatacaaaacgtactgtacggctacgcactactactgtctcactttccg

SEQ ID NO: 357681 - DNA, 677 bp, Homo sapiens
  misc_feature: GZ8MTXP02GJQ3T.10.44.D11.1.454.CMB.2.raw
  modified_base (329)..(329): a, c, t, g, unknown or other
  misc_feature (329)..(329): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggagtcacagagactctctgtgcagcctgtggtcaccttcagtagctacggcatgcacgtgggtccacaagcctccgaggacaagggtattgggaggttggggngctaggtttgttcagtcgtaggacgggctaggttgttacaagtggttatggactacggacgttccggtaggaaacggggtcctacttaccaccgtatcctaccgaagaacgaactaacttaccgaacgtaaacaactaattagttaagtttaaggaaattacgaaacgtaacgtacctaaacgtaccgtaggaacggtaacggtacgggtagtaactaacgtaacgttacgggtaaacgggaaacgggggaaacgggggaaaccgaacggggtacgggtaacggttaccgaaacggtttaccgttaccggtttacggacggttccggtacgggggaccgtaaccgggg

SEQ ID NO: 357682 - DNA, 643 bp, Homo sapiens
  misc_feature: GZ8MTXP02JKMT4.10.44.D11.1.454.CMB.2.raw
  modified_base (271)..(271): a, c, t, g, unknown or other
  misc_feature (271)..(271): n is a, c, g, or t
  modified_base (362)..(362): a, c, t, g, unknown or other
  misc_feature (362)..(362): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcctgtgcagcctgtgggttcaccttcagtanctacggcatgcacgtcgggtccaccaagcctccgaggcgaagggattgggaggtggggtggctagtttgtttcatcgtggacggctagttntacaagtggtatgctagactccggtagaacgggtcattccacctatcctacagacgactacgttacccgaaaggtaacactaagttacgttagtttaacggaaatacgaactaccggtacctaaacgtccgtagggaacggacgtaacgggttataataaccgtacgtaggtaaacgggaaacggggggacggggaaacccgaggggaccggggtaacgttacgaaacgttcccgttaccggttaggtaccgtccgggtaccggggaccgttaacccgggg

SEQ ID NO: 357683 - DNA, 630 bp, Homo sapiens
  misc_feature: GZ8MTXP02G0DDK.10.44.D11.1.454.CMB.2.raw
  modified_base (294)..(294): a, c, t, g, unknown or other
  misc_feature (294)..(294): n is a, c, g, or t
  modified_base (314)..(314): a, c, t, g, unknown or other
  misc_feature (314)..(314): n is a, c, g, or t
  modified_base (326)..(326): a, c, t, g, unknown or other
  misc_feature (326)..(326): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcctgtgcagcctcgtgggttcaccttcagtagctacggcatgcacgtgggcccnccaagcctcgaggcaagggnttggagtggggngctagtttgttcagtcgtggacggggctagttgtacaagttggtatggacaggacctccggtaggaacggggccctagttccaccgtactcctaccgaagacgaacaacttaccgaaggtaaacaactaagttagttaatttaggaaatacgaaactagtaccttaacgtccgtaggacggaacgtacgggtagtaacgttacgtaacgtacgggtaaacggaacggggaacgggggaaacacgggtacggtacgttaccgaagttacgtacgttacggacggtcggtacgggaccgtaccggg

SEQ ID NO: 357684 - DNA, 700 bp, Homo sapiens
  misc_feature: GZ8MTXP02G384M.10.44.D11.1.454.CMB.2.raw
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (331)..(331): a, c, t, g, unknown or other
  misc_feature (331)..(331): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggtttcctcgttgctcttttaagaggtgtccagtgtcaagtgcaactggtggagtcgtgggggagcgtggtccagcctgggagtcacagagactctcctgtgcagcctctgggttcaccttcagtagctacggcatgcacgtggtccncaagctccgaggcaagggnttggagtggggtgctaggtttnttcatcgtggaggggtcaggttgtacaagttgggtatggcaggaccttaccggtggaaacggggccaattaccacctaattccaccaggaacgaacgtaaacttcccgaaaggtaaaccactaaacgttaaggttaatttaaggggaaaattacggaaactaacgtacccgttaaaacggtcccgtaacgggaaagaccggtaaacggggttagtaaacgttaacctaacgtacgggaccgaaacggggaaaacgggggaacggggggaaaacccgaaggggaccgggggtaaacgttaacccggtaaaacggttaccgtttacccggtttaacggtacccggttcgggttaaccgggggtaccccggg

SEQ ID NO: 357685 - DNA, 590 bp, Homo sapiens
  misc_feature: GZ8MTXP02ISMND.10.44.D11.1.454.CMB.2.raw
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcctgtgcagcctctgggttcaccttcagtagctacggcatgcacgtcgggtccgccaagctccgaggcaaagggattggagtggggtggctagttgttcatcgtggagggcaggtgttacaaattggttatggcagtactccgtggaaagggccgattcaccatctacagaacgactaaattccaaggaacaacaaatagttaaattttaggaaaattagaaactaggaccctaaaggtccctaggaacgacgaaggtagtaatactaacgtgtaaacggaaagggaagggggaaccgaggacgggagttaccaagtactccgtttagacgtcgtcggggacctacggg

SEQ ID NO: 357686 - DNA, 808 bp, Homo sapiens
  misc_feature: GZ8MTXP02J05S2.10.44.D11.1.454.CMB.2.raw
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
  modified_base (324)..(324): a, c, t, g, unknown or other
  misc_feature (324)..(324): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctcgtgggttcaccttcagtagctacggcatgcacgtgggtccnccaagctccgaggcaagggnttggagtgggngctagttgtttcatcgtggacgggctaggttgttacaaagttgggtatgacgagtaccgtccggtaggaaacgggggtcccctagttacccaaccctaacttacccgttaccgaaacggaacgtaaccgtaaacctttaccccggaaagggtaaacccaaccgtaaaagttacggtttaaagttttaacggggaaaattacggaaaaccgtaacgggtaaccccgttaaaacggttccccgttaacgggaaacggggtaaaccgtaaccgggggtttagttaaacgttaaaccgtttaaccggttaaggggttaaaacccggggaaaacggggggtaaaccggggggggtaaaacccgaacgggggtacccgggggttaaaacggtttaaccccggtaaaacgggttaaacccggtttacccggttttaacgggtaacccggggtttccgggttaccggggggttaccgttaaaccccgggggg

SEQ ID NO: 357687 - DNA, 653 bp, Homo sapiens
  misc_feature: GZ8MTXP02GA3H7.10.44.D11.1.454.CMB.2.raw
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
  modified_base (292)..(292): a, c, t, g, unknown or other
  misc_feature (292)..(292): n is a, c, g, or t
  modified_base (317)..(317): a, c, t, g, unknown or other
  misc_feature (317)..(317): n is a, c, g, or t
  modified_base (339)..(339): a, c, t, g, unknown or other
  misc_feature (339)..(339): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcctgtncagcctcgtggtcaccttnagtgctacggcatgcacgtgggtcccnccaagcctccgaggcgaaaggggtnttggaggtgggtgctaggtttnttcatcgtgacgggctagtgttacaagtggtatgacaggtaccgtccgtaggaacggggtccattaccacctatccgtaccaaggacgtaacaacgttaccgaaggaaacacgtaaagttagttaagtttaagggaaacttagaaacctacgtaaccgttaacgtccgtaggaacggtaacgacgggttacgtactaacgttacgtacggtaaacgggaaacggggtaacgggggaaaccacggggtaccgggtagttaccgtaacggttaccttaccgtttacggaccgtacggtaccggggaccgtaccggg

SEQ ID NO: 357688 - DNA, 836 bp, Homo sapiens
  misc_feature: GZ8MTXP02HEQY7.10.44.D11.1.454.CMB.2.raw
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagcctgggagtcacagagactctcctgtgcagcctcgtgggttccaccttcagtagctacggcatgcacgtgggtcccaccaagcctccgaggcgaaggggattgggagttggggtggctaggtttcgtttcagttcgtgacggggtctaggttgttacaagttgggttatcggacgtaacggtaaccgttcccgggtagggaaaacgggggtccccgttaactttacccgaaccctaacgttcccgtaccccggaaaggaaacccgtaaacccttaaaaccgtttaaccccgaaaacggggtaaaacccctaaaaccgtaaaagtttaacggtttaaagtttttaaaggggaaaaactttaacggaaaacccgtaaccgggtaaccccttaaaacggttaccccgtaagggtaaacgggtaacccggttaaccgggggttataaacgttaaaccgttaaccggttaacgggttaaacggggaaaacgggggtaaacggggggtaaaaccccagggggtaacccggggttaaaccgttacccggtaaaacggttacccgttaccggttttacgggaacccggttccgggtaccgggggtaccccggttaaacccggggg

SEQ ID NO: 357689 - DNA, 717 bp, Homo sapiens
  misc_feature: GZ8MTXP02H8PA6.10.44.D11.1.454.CMB.2.raw
  modified_base (297)..(297): a, c, t, g, unknown or other
  misc_feature (297)..(297): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtggtccagcctgggaggtcacagagactctcctgtgcagcctcgtgggttcaccttcagtagcctacggcatgcacgtcgggtccnccaagcctccgaggcaagggattggaggtgggtgctagttgtttcagttcgtggacgggctagttgtacaagttgggtaatggcgtagtaccgttccggtaggaaacggggtccgtaattaccgaacccattacctaccgaaggaacgtaacctaacgttacccgaaacggaaacctaacgaaattaggtttaacgtttaaaggtaaaacgttagaaactacgtaaccgtaaacgtacccgtaggtaacgggaacgtaaccggggtagtaacgttaaccgtttaaacgtaacgggttaaacgggaaaagggggaaacggggggtaaacccgtaacggggacgggggtaacggttacccgaaaaggttacccgttaccgtttacggtaacggttccggtacgggggtacccgtaaccgggg

SEQ ID NO: 357690 - DNA, 745 bp, Homo sapiens
  misc_feature: GZ8MTXP02JJZMQ.10.44.D11.1.454.CMB.2.raw
  modified_base (325)..(325): a, c, t, g, unknown or other
  misc_feature (325)..(325): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtgagtcgtgggggagcgtggtccagcctgggagtcacgagagactctctgtgcagcctgtggtcacttcagtagctacggcatgcacgtgggtccaccaagcctccgaggcgaagggtattgggaggtggggnggtctaggtttgttcagttcgtaggacggggtctaggttcgttacgaagttgggtaatcggacctaggaccgttcccgggtagggaaaccggggtcccgtacttaccgaccctattccctaccgaaggaacgaacctaacgttacccgaaaggaaaccacgtaaagttagttaaagtttaacggtaaaagttacggaaaacctacggtaacccgtaaacgttacccgtaaggtaacgggtaacgtaaccggggttagtaaacttaaaccgttaaccgtaagggttaaaccgggaaaacgggggtaaacgggggaaacccgtacggggtaaccggggtaacgttaacccgtaaacggttacccgtttacccggtttaacggaccggttaccggtaccgggggtacccgttaaacccggggg

SEQ ID NO: 357691 - DNA, 702 bp, Homo sapiens
  misc_feature: GZ8MTXP02HQCW9.10.44.D11.1.454.CMB.2.raw
  modified_base (292)..(292): a, c, t, g, unknown or other
  misc_feature (292)..(292): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacagagactctctgtgcagcctcgtggttcacttcagtagctacggcatgcacgtcggccnccaagcctaccgaggcaagggtattggaggtgggtgctagtttgttcatcgtggacgggctaggttgttacaagttgggtatggactaggtaccgttccggtagggaacggggtcctaattccacctactcccgtaccgaagaacgtaacctaaacgttaccgaaacggtaaacctaacgtaaagttagttaaagtttaagggaaaacttacgaaacgtaacgtaaccgttaaacgttaccgtaggtaacggtaacgtaacggggttagttaacgttaacgtaacgtaggtaaacgggaaacgggggtaaacgggggaaaccgacggggaaccgggtaacgttaccgtaaacggttaccgttaccggtttacggaaccggttccggtacgggggtaccgttaacccgggg

SEQ ID NO: 357692 - DNA, 761 bp, Homo sapiens
  misc_feature: GZ8MTXP02HC341.10.44.D11.1.454.CMB.2.raw
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcctgtgcagcctctgggttcaccttcagtagctacggcatgcacgtgggtccnccaagcctccaggcaagggnttgggagtggggtgctaggtttgttcagtcgtggacggggtcaggttgtacaagttgggtatggactaaggtaccttccggtaggaaacgggggccctaatttccaacccgtactacccgtacccgaaaggtaacgtaacctaaaccgtttacccgaaacgggtaaaacccaaaccgtaaagttaacggttaaagttttaaagggaaaagttacggaaaacctaacgggtaacccttaaaggtaccccgtaagggtaacgggaaccgtaacgggggttagttaaacgttaaccgttaacgtacgggttaaaaccggggaaacgggggtaaaccggggggtaaaacccgacggggtaccgggggttaacgtttaacccggaaacggtttaaccgttcccgtttacgggtaaccggtttcggtaccgggggtacccgttaaacccggggg

SEQ ID NO: 357693 - DNA, 589 bp, Homo sapiens
  misc_feature: GZ8MTXP02HZMGD.10.44.D11.1.454.CMB.2.raw
  modified_base (252)..(252): a, c, t, g, unknown or other
  misc_feature (252)..(252): n is a, c, g, or t
  modified_base (293)..(293): a, c, t, g, unknown or other
  misc_feature (293)..(293): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcctgtgcagcctntggggttcaccttcagtagctacggcatgcacgtgggtccnccaagcctccaggcaaaggggattgggagttggggtaggctaggttgtttacgatcgtaggacggggcaaggttcgttacgaaagttggtatgacagacctccgtagaacggggcctaattccaaccatctacccgagacgactaacttaccgaaggaaaccaacaatagtaagttagaaatagaacagactaagtcgtaggaagacgaggtataactactacgtaggtaggaaacgggacggggaacaggacggagtacgaacgtactacgttcgacgtcggacgggtacgacgg

SEQ ID NO: 357694 - DNA, 747 bp, Homo sapiens
  misc_feature: GZ8MTXP02JNIJX.10.44.D11.1.454.CMB.2.raw
  modified_base (268)..(268): a, c, t, g, unknown or other
  misc_feature (268)..(268): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacgagagactctcctgtgcagcctcgtcgggttcaccttnagtacgcgtacggcatgccacgtcgggtcccaccaagcctccgaggcgaaggggtattgggaggtcggggtggacttaggtttcgtttacagttcggtaggacgggtctaggttcgttacgaagttggtatggaccgtaaggtacccgttccgggagggtaaccggggtcccttagttacccaacccgtacttcccgtaccgaacggtaaccgtaactaaaccgttacccgaaaacggtaaacctaacgtaaacgtttaggttaaacgttttaaggaaaacttacggaaacctacgtaacccgttaaacgtaccgtaggaaccggtacgtaacggggttactaacgttaaccgtaacgtacggtaaacgggaaacgggggaacgggggtaaaccgacggggtaaccgggtacgtaaccgtaacgttaccgttaccgttacggtacccggttacggtaccgggggtacccgtaccggggg

SEQ ID NO: 357695 - DNA, 581 bp, Homo sapiens
  misc_feature: GZ8MTXP02IFQMN.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggaggcgtggtccagcctgggaggtcacagagactctcctgtgcagcctcgtgggttcaccttcagtagctacggcagtgcacgtcgggtccaccaaggcctccgaggcaaggggattgggagtgggtggctagttgttcatcgtggaggctagtgttacaagttggtatggcaggaccgtccgtgggaacggggccattccgaccattcaccagagactaacttacgaagaacacaattagtaatttaggaaatagaacagacctagctaggagacgaggtagtatacgtacgtaggtacggaagggacgggggaacacgggcggtacgttacgaagtacgtcgttacgacgttcggacgggtaccgtacgggg

SEQ ID NO: 357696 - DNA, 793 bp, Homo sapiens
  misc_feature: GZ8MTXP02IE8M1.10.44.D11.1.454.CMB.2.raw
  modified_base (165)..(165): a, c, t, g, unknown or other
  misc_feature (165)..(165): n is a, c, g, or t
  modified_base (292)..(292): a, c, t, g, unknown or other
  misc_feature (292)..(292): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttggctgaactgggtttcctcgttgctcttttaagnggtgtccagtgtcaagtgcaactggtggagtcgtggggggagcgtggtccaggcctgggagtcacagagactctcctgtgcagcctcgtggttcaccttcagtagctacggcatgcacgtgggtccnccaagctccgaggcaagggattggaggtggggtggctaggttgtttcagtcgtggagggctagttgttacaagttcggtaattgggcctaaggaccgttcccggtaggggaaacgggggtccctaaatttacccgaacctacgttcctaccgaaggaacgtaacgtaaaccgtttaccgaaacgggtaaaccaaacgtaaagttaggtttaaagtttaaagggaaaatttacggaaaaccgtaacgggtaaccccgttaaaagggttccccgtaagggtaacggggtaaacccggttaagggggtttaacgttaacgttaaaccggttaaacggttaacggggttaaacccgggggaaaaggggggtaaaccgggggggtaaaacccgacgggggtaaccggggttaacggtttaacccggtaaaacggtttacccggtttaccggtttttacgggaaccgggtttccgggtacgggggtaccccggtttaaacccggggg

SEQ ID NO: 357697 - DNA, 781 bp, Homo sapiens
  misc_feature: GZ8MTXP02G97EX.10.44.D11.1.454.CMB.2.raw
  modified_base (312)..(312): a, c, t, g, unknown or other
  misc_feature (312)..(312): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctcgtgggttcaccttcagtagctacggcagtgcacgtggccacaagcctccgaggcaagggntggagtgggtgctagtttgtcagtcgtggacgggctagtgtacgaagttgggtaatcggactacggtaccgttccgggtagggaaacggggccctaagtttacccgaacctacgttcccgtacccgaaaggtaacgtaaacctaaacgttacccgaaacgggaaacctaaaccgtaaatttacgggttaaaagttttaaacgggaaaaagtttaccgaaaaaccgtaccgggtaaacccgtttaaaacgttcccggttaagggaaacggggtaacccggttaacgggggttaacgttaacgttaaacccggttaaccggtaaggggttaaaaccggggaaacgggggaaacggggggaaacccgtaagggggacccgggggttaacgtttaacccggtaaaacggttacccgtttaccggtttacggtaccggttccgggtaaccgggggtcccgtttaaacccggggg

SEQ ID NO: 357698 - DNA, 689 bp, Homo sapiens
  misc_feature: GZ8MTXP02G9AB7.10.44.D11.1.454.CMB.2.raw
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaagtggtggagtcgtgggggagcgtggtccagccgtgggagtcacagagactctcctgtgcagcctgtgggttcaccttcagtacgctacggcatgcacgtcgggccaccgaagcctaccgaggacgaaaggggtatgggaggtggggtggctaggtttgtttcagttcgtggacgggtctagttcgttacaagtggtatgacaaggtacctccggtaggacgggccctattccaccactctaccgaagaacgaactaaacttaccgaaaggaaaccaactaaagttagttaagtttaaaggaaaattacgaaaacgtacgtaacctaaacgtaccgtaggaacggtacgtacgggtataaacgttaacgtaacgtaacggtaacgggaaaaggggaacgggggaaaccgacgggtaaccgggtaacggttaacccgtaaacggttaccgttaccggttacggtaaccggttccggtacgggggtacccgtaacccggggg

SEQ ID NO: 357699 - DNA, 540 bp, Homo sapiens
  misc_feature: GZ8MTXP02I6G6I.10.44.D11.1.454.CMB.2.raw
  modified_base (167)..(167): a, c, t, g, unknown or other
  misc_feature (167)..(167): n is a, c, g, or t
  modified_base (291)..(291): a, c, t, g, unknown or other
  misc_feature (291)..(291): n is a, c, g, or t
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (411)..(411): a, c, t, g, unknown or other
  misc_feature (411)..(411): n is a, c, g, or t
  modified_base (429)..(429): a, c, t, g, unknown or other
  misc_feature (429)..(429): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagnggtgtccagtgtcaagtgcaactggtggagtcgtgggggagcgtggtccagcctgggagtcacagagactctctgtgcagcctctgggttcaccttcagtagctacggcatgcactgggtcccnccaagctccgaggcaaggggtattgggagtggggtaggctagtttgttcatcgtgaggcagtgtacaatggatggcagactcgtgaagggcattcaccatcncanagacaatcagaacanatagtattagaatagaanagactaagtacgtagagacgaggtagtatactactagtaggaaggaaggggaacggagacggacgtacgtaacgtacgtacgttacgtacgtacgtcgggacgtaaccggg

SEQ ID NO: 357700 - DNA, 700 bp, Homo sapiens
  misc_feature: GZ8MTXP02FW17X.10.44.D11.1.454.CMB.2.raw
  modified_base (293)..(293): a, c, t, g, unknown or other
  misc_feature (293)..(293): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctctgggttcaccttcagtagctacggcatgcacgtgggtcccnccaagcctccgaggcaaggggtattgggaggtggggtgctaggtttgtttccagttcgtggacggggtctaggttgttacaaagttggttaatggactaggtaccgttcccgggtaggaaacggggcctaatttaccgacctacttccgtaccgaaggaacgtaacctaacgttacccgaaaggaaacctaaacgtaagttagttaaagtttaaggaaaagttacggaaacctacggtaacccgttaaacggtcccgtaggaacgggtaacgtacgggttagttaacgtaaccgttaacgtagggtaaacgggaaaggggaacgggggtaaaccaggggtacggtaagttaccgtaagttaccgttaccgtttacggaccggttcggtacggggaccgtaaccgggg

SEQ ID NO: 357701 - DNA, 763 bp, Homo sapiens
  misc_feature: GZ8MTXP02IARY5.10.44.D11.1.454.CMB.2.raw
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggaggcgtggtccagccgtgggaggtcacagagactctcctgtgcagcctcgtgggttccaccttcagtagcctacggcatgcacgtcgggtccaccaagcctccgaggacgaaaggggtattgggaggtggggtggcttagttgttcagtcgtggacgggtctaggttgtacgaagttgggtatcggactaacggtaccgttccgggtaggaaaccgggggtcctaactttacccaacccgtacttacccgtacccgaaggtaaaccgtaaacgtaaacgttaacccgaaacgggtaaaacctactaaaagttagttaaagttttaagggaaaattaacggaaaactaacggtaccttaaaggtacccgtaaggaacggtaacggtaaccgggttagttaaacgtaaccgtacgttaacgggtaaaccggggaaaaggggtaaaccggggggaaaccgtaacggggtaccggggtaaacgtttaaccgaaacggtttaacccgtaccggtttacggacggtttaccgggtacgggggtaacccgtaacccggggg

SEQ ID NO: 357702 - DNA, 608 bp, Homo sapiens
  misc_feature: GZ8MTXP02G4TOL.10.44.D11.1.454.CMB.2.raw
  modified_base (369)..(369): a, c, t, g, unknown or other
  misc_feature (369)..(369): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtggggggagcggtggtccagccgtggggagtcacagagactctcctgtcgcagcctcgtgggttcaccttcagtagctacggcatgcacgtcgggtccaccaagcctaccgaggacgaagggattgggaggtgggtggctagtttgttcagtcgtgagggctagttntacaagtggtactgcaggtacctcgtaggaacgcctattcacctatctacagacgacaactccgaagaacactaagtgtaagttaggaaatagaaacagtacctaacgtcctaggacgacgtacgggtataagtaacttacggtaggtaaacggagggggaacggggaaacctacgggacggtacgttacgtaacgtcgttaccgttaggaccgtacggtacggggaccttaaccgggg

SEQ ID NO: 357703 - DNA, 730 bp, Homo sapiens
  misc_feature: GZ8MTXP02H7XN7.10.44.D11.1.454.CMB.2.raw
  modified_base (253)..(253): a, c, t, g, unknown or other
  misc_feature (253)..(253): n is a, c, g, or t
  modified_base (292)..(292): a, c, t, g, unknown or other
  misc_feature (292)..(292): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggagcgtggtccagcctggggagtcacagagactctctgtgcagcctntgggttcaccttcagtgctacggcatgcacgtgggtccnccaagcctccgaggcaaggggtattgggaggttggggtggctaggttgtttcagtcgtggacggggcaggttgttacaagttgggtaatggactaggtaccgttaccggtagggaacggggccgtaacttaccaccgactcctaccgaacgaacgtaaacctaacgttaccgaaacgggaaaacctacgtaaagttagttaacgtttaaagggaaaacttaacgaaacctaacggtaacccgttaaacggtacccgtaggtaacgggaacgtaaccggggtagttaaacgttaaaccgtaacgtaacgggttaaacggggaaaacggggtaacggggggaaaaccgtacgggaacggggttaacggtaacccgtaaacggttacccgttaaccgtttacggtaaccggtccgggtacgggggtacccgtaaccggggg

SEQ ID NO: 357704 - DNA, 746 bp, Homo sapiens
  misc_feature: GZ8MTXP02IE2DF.10.44.D11.1.454.CMB.2.raw
  modified_base (290)..(290): a, c, t, g, unknown or other
  misc_feature (290)..(290): n is a, c, g, or t
  modified_base (313)..(313): a, c, t, g, unknown or other
  misc_feature (313)..(313): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttggctgaactgggttttcctcgttgctcttttaagaggtgtccagtgtcaagtgcaactggtggagtcgtgggggagcgtggtccagcctgggagtcacagagactctctgtgcagcctctgggtcaccttcagtagctacggcatgcacgtgggtcccnccaagcctccgaggcgaagggtnttgggaggtggggtgctagtttgtttcatcgtggacgggctagtgttacaagttggtatcggctaggaccgttcccgggtagaaacgggggccctaatttccgaaccctacttccgtacccgaaggaacgaacctaaacttacccgaaacgggtaaaccaacgtaattagttaaagtttaaggaaaacttagaaacctacgtaacccgttaaacgtcccgtaggtaacgggtaaacgtacggggttacgtaaacgttaaccgtaaacggttacgggtaaacgggaaaacgggggtaaaccggggggaaaaccgaacgggggtaaccggggtaaccggtttaacccggtaaaacgggtttaacccgtttaccggttttacgggtaaaccggtttcccgggttaacggggggtaccccggtttaaacccgggggg

SEQ ID NO: 357705 - DNA, 756 bp, Homo sapiens
  misc_feature: GZ8MTXP02HKTVC.10.44.D11.1.454.CMB.2.raw
  modified_base (292)..(292): a, c, t, g, unknown or other
  misc_feature (292)..(292): n is a, c, g, or t
tcagcatagtagtgcacgaccggtgctcgatttagcgcagtacgaagggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcctgtgcagcctctgggttcaccttcagtagctacggcatgcacgtgggtccnccaagcctccaggcaaggggattgggagtggggtggctaggtttgtttcatcgtggacggggctaggttgttacaagttgggtatgggctaaggaccgttccgggtagggaaacggggtcccgtaattccaacctaattcccgtaccgaagaacgtaacctaaacgttacccgaaagggaaaccaactaaagttaggttaaagttttaagggaaaatttacggaaacgtaaacgggtacccttaaaacggtccgtaaggtaacggggaaccgtaacgggggttagttaaacgtaaccgtttaaacggtacgggttaaaaccggggtaaacgggggaacggggggtaaaacccgaagggggtaccgggggttaaccggttaacccggtaaaacggttacccgttaacccggtttacgggtaaacccgtttcggggtaccgggggtacccggtttaaacccggggg

SEQ ID NO: 357706 - DNA, 570 bp, Homo sapiens
  misc_feature: GZ8MTXP02HKLZW.10.44.D11.1.454.CMB.2.raw
  modified_base (293)..(293): a, c, t, g, unknown or other
  misc_feature (293)..(293): n is a, c, g, or t
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (402)..(402): a, c, t, g, unknown or other
  misc_feature (402)..(402): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacagagactctctgtgcagcctgtgggttcaccttcagtagctacggcatgcacgtgggtccnccaagctaccgaggcaaagggattggagtgggngcagttgttcatcgtgagggnagtgtnaatggatcgcaagctccgtgagtgggccgattcactatctcagacgaanaactaccaagacaacaaatgtatttaggaaatgaacagactaaagtccgtagaacggactacgggtagtaactactaacgttaggaaacggaaaggggaaacgggggaaccagggacgggaacgttaaccgaaagttaacgtccgttgaaccggtcgtcggggaccgg

SEQ ID NO: 357707 - DNA, 627 bp, Homo sapiens
  misc_feature: GZ8MTXP02IZ3H7.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcctgtgcagcctcgtgggttcaccttcagtagctacggcatgcacgtgggtccacaagcctccgaggcaagggattgggaggtgggtggctaggtttgttcatcgtggaggggcagtgttacaagttgggtatgcaggacctccggtaggaacggggccgtattccacctatcctacgagacgactactacaaggaacacaatgtatttaggaattagaacagtacctaagtccgtaggacggaacgtacgggttagtaacgtaccgttaacgtaggttaaacgggaaacgggggaaacgggggaaccgacgggtaccgggtaaggtaccgtaaacggtaccgttacgttacggaccggttacgtcgggggtacccgtaaccgggg

SEQ ID NO: 357708 - DNA, 740 bp, Homo sapiens
  misc_feature: GZ8MTXP02HJFFR.10.44.D11.1.454.CMB.2.raw
  modified_base (272)..(272): a, c, t, g, unknown or other
  misc_feature (272)..(272): n is a, c, g, or t
  modified_base (302)..(302): a, c, t, g, unknown or other
  misc_feature (302)..(302): n is a, c, g, or t
  modified_base (327)..(327): a, c, t, g, unknown or other
  misc_feature (327)..(327): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggaggcgtggtccagccgtgggaggtcacagacgactctcctgtgcagcctcgtgggtcaccttnagtagctacggcatgccacgtcgggtcccnccaagcctccgaggacgaaggggtnttgggaggtggggtgctaggtttgttcgatcgtaggacgggctaggtgttacaagtggtatgcgtaagtaccgtccggtaggaacgggcctattccgaacctatcctaccgaagtaacgtactaaacgttccgaaaggtaaaccaacgtaaagttcgtttaaagtttaaacggaaaagttacgaaaacgtaacgggtaaccccgttaaacggtacccggttagggaaacgggttaacggtaccggggtttaaggttaaaacttaaccggttaacggtaacgggtaaacgggggtaaaacgggggaaaccgggggaaaccggtacggggtaacggggttaaccgttacccggaaaacggtttccgtttaccggttacggaccggttcggggtacggggtacccggtaaccgggg

SEQ ID NO: 357709 - DNA, 675 bp, Homo sapiens
  misc_feature: GZ8MTXP02HGXOE.10.44.D11.1.454.CMB.2.raw
  modified_base (353)..(353): a, c, t, g, unknown or other
  misc_feature (353)..(353): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactctccgtgtgcagccctgtcgggttcaccttcagtagctacggcatgcacgtcgggtcccaccaagcctaccgagggacgaaaggggtattgggaggtggggtgctaggtttnttcatcgtggagggtctaggttgttacaagttggtatcggacagtaccgttccggtagggaacggggcctaattccacctatccacgaagaacgaactaactaccgaaaggaaacactaaagttgttaaagtttaggaaaagttagaaacacgtaaccgtaaagtccgtaaggacggtaacgtacgggtagtaactaaccgttaagtacggtaaacgggaaacgggggacgggggaaacccgaggggtaccgggtaactaaccggtaaagttaccgtaccggtttaggaccggttcggtaacgggggtaccgttaaccgggg

SEQ ID NO: 357710 - DNA, 697 bp, Homo sapiens
  misc_feature: GZ8MTXP02FUBW9.10.44.D11.1.454.CMB.2.raw
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
  modified_base (314)..(314): a, c, t, g, unknown or other
  misc_feature (314)..(314): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctcgtgggtcaccttnagtagctacggcatgcacgtgggcccncaagcctccgaggcaaggggnttgggagtggggtgctagtttgttcagtctggaggtctagtgttacaagtgggtactgcagtacgtccggtagaacggggtcctagttacaccctaacgtcctaccgagtaacgaactaacttacccgaaaggaaccaaacgtaaaattggttaaagttttaaggggaaaacttacgaaacgaacggtacccgttaaaacgtcccgttaggaaacggggtaaccgtacgggggttaactaacgtaacgttaacggttacgggtaaaccgggaaagggggtaacggggggaaaccgtacggggaccggggtacgttacccggaaacgttaccggttaccgtttacgggtaaccggttcggtacgggggtccgttaaaccggggg

SEQ ID NO: 357711 - DNA, 596 bp, Homo sapiens
  misc_feature: GZ8MTXP02GD6VX.10.44.D11.1.454.CMB.2.raw
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
tcagcatagtagtgcacgaccggtgctcgatttagcgcagtacgaaggggggagaggatcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcctgtgcagcctcgtgggttcaccttcagtagctacggcatgcacgtgggtccnccaagctccgaggcaaggggnttgggagtggggtgctagtttgttcatcgtggacggcagttgttacaagttggtatgacaggacctccggtagaaacggggccctattccaacctatcctaccgaagtacgacaattaccgaagaacacaatgtaattagaaatagaacagtacctaaagtccgtaggacggacgaggggtactaatacgtacgtacggtaaggaaacggggacgggggaaccaggacgggtaattaccgaagttacctcgtttacggacgtcggtacggggctaaccggg

SEQ ID NO: 357712 - DNA, 562 bp, Homo sapiens
  misc_feature: GZ8MTXP02GQVKJ.10.44.D11.1.454.CMB.2.raw
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcctgtgcagcctctgggttcaccttcagtagctacggcatgcacgtgggtccgccaagcctccaggcaagggattgggagtggggtggctagttgtttcatcgtgaggggcaggttgttcaagttggtatgcagactccgtgaagggccattcacatctaccagagacactaccaggaaacacaatagtaatttaggaaatagaactagacctaagtcctagaggacgacgggtagtatactatagtaacggaagggaacgggggaacgaggacgggtagtacgaagtactacgttagacgtcgtcggggaccgtacgggg

SEQ ID NO: 357713 - DNA, 589 bp, Homo sapiens
  misc_feature: GZ8MTXP02HSG24.10.44.D11.1.454.CMB.2.raw
  modified_base (294)..(294): a, c, t, g, unknown or other
  misc_feature (294)..(294): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcctgtgcagcctctgggttcaccttcagtagctacggcatgcacgtgggtccncaagcctccgaggcaaaggggattggaggtgggtggctaggtttgttcatcgtggagggcagtgttcaagttgggtatgcagactccgtaggaacgggcctatcaccatctaccagagacaacttccgaaggaacacaagtagttaagtttaggaaattacgaactacgacctaaagtccgtagacggacgacggtgtatacgtacgtaggtaacggaacgggacgggggaaacgacgggacgggtaagttacgaagtaccgtacgtttacgacgtcgtacggggacgtaccggg

SEQ ID NO: 357714 - DNA, 597 bp, Homo sapiens
  misc_feature: GZ8MTXP02F95UD.10.44.D11.1.454.CMB.2.raw
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctctggggtcaccttcagtagctacggcatgcacgtgggtccncaagctccgaggcaagggnttggagtgggtggctagtttgtttcatcgtggacggggcagtgttacaagtgggttatgacagactccgtgaacggggcctattcaccatctccagagacaacttaccaagaacaactaattagttaatttaggaaatagaaacaacggacctaacgtaccgtagacggtacgacgggtagtataactaacgtaggtaacggaaaggggacgggggtaaaccgacggacgggtacgttaccgaacgttactccgttacgacgtcggtacgggcgtaaccccgggg

SEQ ID NO: 357715 - DNA, 762 bp, Homo sapiens
  misc_feature: GZ8MTXP02I084G.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcctgtgcagcctctgggttcaccttcagtagctacggcatgcacgtcgggtcccaccaagcctccgaggcaaggggattgggaggtggggtgctagtttgttcatcgtggacgggctaggttgttacaagttgggtaatggcacggtacctccgggtagggaaacggggccctattccgacctataccgtaccgagaacgaactaacgttaccgaaacggtaaaccaaacgtaaagtttaggtttaaagttttaaagggaaaacgtttacggaaaacccgtaccggttaaaccccgttaaaccgttaccggtaacgggtaaacgggtaaaccggttaaccggggtttaagttaaaccgtttaaaccggttaaacccggttaggggtaaaaccggggaaagggggtaaaccggggggaaaccgtaacgggggaccgggttaaccggttaaccgtaaacggttacccgtttaccgtttacgggtaaccggttcggtaccgggggtaccggttaacccggggg

SEQ ID NO: 357716 - DNA, 704 bp, Homo sapiens
  misc_feature: GZ8MTXP02G6FI2.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacagagactctcctgtgcagcctcgtgggttcaccttcagtagctacggcatgcacgtggtccaccaagcctccgaggcaaaggggtattggaggtgggtgctagttgtttcagtcgtggacggtctaggttgttacgaagttggtatggcgtaagtaccgttccggagggaacggggtcctattccgacctactccgtaccgaaggtaacgtaactaacgttaccgaaacgggtaacctaaacgtaattaggttaagtttaaagggaaactacggaaacctacggtaaccgttaaacgtccgtaaggtaacgggtaacgtacggggtaacgtaacgttaaccgtaacgtagggtaaaccgggaaacgggggaaccgggggtaaaccgacggggtaccggggtaacgttaccggtaacgttaccgttaccggtttacggtaccggtcggtacggggtaccgttaacccggggg

SEQ ID NO: 357717 - DNA, 818 bp, Homo sapiens
  misc_feature: GZ8MTXP02H20A7.10.44.D11.1.454.CMB.2.raw
  modified_base (323)..(323): a, c, t, g, unknown or other
  misc_feature (323)..(323): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacgagagactctcctgtgcagcctgtgggttccaccttcagtgctacggcatgcacgtcgggtcccacaagcctaccgaggcgaaaggggtnttgggagtggggtgcttaggtttcgttcagtcgtggacggggctaggttcgtactaagtggttatggactaacggtacccgttccgggtaagggaacggggtacccgtaactttacccgaacccgtaaacgttcccgtaacccgaaaggaaacgtaaaacccgttaaaacccgttacccggaaaacgggtaaaaccctaaaccgtaaaagtttaaacggtttaaaggttttaaaacgggtaaaaacgttacggtaaaaacccgtacggttaaaccccgttaaaacggttcccgtaaagggtaacgggtaaacggttaaccggggttagttaaacgttaaaccgttaacgggtaacgggttaaaccgggggaaaacgggggtaacgggggaaaacccgtacggggtaccggggttaaccgttaacccggtaaacggttacccgtttaccggtttacggtacccggtacggttaccggggtacccggtaacccgggg

SEQ ID NO: 357718 - DNA, 738 bp, Homo sapiens
  misc_feature: GZ8MTXP02JBECE.10.44.D11.1.454.CMB.2.raw
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctctgtgcagcctgtggttcaccttcagtgctacggcatgcacgtggtccncaagcctcgaggcaagggntggaggtgggtgctagtttgttcatcgtggacgggtctagtgttacaagttggtatggcaagtaccgtccgggtaggaaacggggtcctaagttccaacccgtattcccgtaccgaaaggtaacgaacctaaacgttacccgaaacggtaaaacctaactaaagttaggttaaagtttagggaaaacttacgaaaacgtacgaacccgttaaacggtacccgtaggaacggggtaaaccgtacgggggttaagttaaacgtaaccgttaacggttacgggttaaaacggggaaaacgggggtaaacgggggaaaccccgtaggggtacccgggggtaaccgtttaacccggtaaaacggttacccgtttacccggtttacgggacccggtttaccggggtaccgggggtaccccgtttaaacccggggg

SEQ ID NO: 357719 - DNA, 665 bp, Homo sapiens
  misc_feature: GZ8MTXP02JCB00.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggtttcctcgttgctcttttaagaggtgtccagtgtcaagtgcaactggtggagtcgtgggggagcgtggtccagcctgggagtcacagagactctcctgtagcagcctcgtgggttcaccttcagtagctacggcatgcacgtgggtccaccaagcctccgaggcaaaggggtattgggaggtggggtggtcaggtttcgttcatcgtggagggctagtgtttacaagttgggtatcgggactaagacgttccggtagaacggggtccgtaattcacctaatcctaccgagaacgaactaacttaccgaaacgggaaacaaaccgtaaagtagttaaagtttaagggaaaacttaacggaaaccctagtaaccccgtaaggtacccgtaggaacggacggtacgggtagtacgtaaccgtacggttacgaaacgggaacgggaaacgggggaacacgggtacggggacgttaccgaaaggtactaccgtttcggacgttacggacgggtacgtaaccgggg

SEQ ID NO: 357720 - DNA, 701 bp, Homo sapiens
  misc_feature: GZ8MTXP02HTJ6E.10.44.D11.1.454.CMB.2.raw
  modified_base (322)..(322): a, c, t, g, unknown or other
  misc_feature (322)..(322): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggagtcacagagactctcctgtgcagcctcgtgggttcacccttcagtagctacggcatcgcacgtcgggtccgccaagcctccgaggacgaaaggggnttgggagtggggtgctagtttgtttcagtcgtggaggggctaggttgttcaaagttgggtatggcaaggtacctccgggtagaacggggccctattccaaccactcctaccagaacgtaactaaacttaccgaacggaaacacgtaaagtacgttaagtttaggtaaaattagaaacgtaacgtaacccgttaagtacccgttaggaacgggacgtaacggggtagtaacgtaaccgttacgttacgggtaacgggaaacggggaacggggggtaaaccgtaacggggaccggggtaacgttaccggtaaaccggtttaccgttaccggtttacggtaaccggttccgggttaccgggggtacccggttaacccggggg

SEQ ID NO: 357721 - DNA, 647 bp, Homo sapiens
  misc_feature: GZ8MTXP02JNIHE.10.44.D11.1.454.CMB.2.raw
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctcgtgggttcacttcagtagctacggcatgcacgtgggccnccaagcctccgaggcaagggnttgggagtgggtgctaggttgtttcatcgtggacggctagttgttacaagttggtatgacagtaccgtccgagaacggggcctagtccacgtatccaccagacgactaacgtaccgaacgaaaccactaaagtagttaacgttaggaaaatacgaaactacgtaccttaacgtaccgtaggaacggacgtacggggttataacgtaacgttaacgtaggtaaacgggaaacgggggacgggggtaaaccgacgggtaccggggtaacgttaccggtaaaggttacccgttccggttacggaccggtttccgggtacgggggacccgtaaccgggg

SEQ ID NO: 357722 - DNA, 655 bp, Homo sapiens
  misc_feature: GZ8MTXP02FZJ2B.10.44.D11.1.454.CMB.2.raw
  modified_base (246)..(246): a, c, t, g, unknown or other
  misc_feature (246)..(246): n is a, c, g, or t
  modified_base (295)..(295): a, c, t, g, unknown or other
  misc_feature (295)..(295): n is a, c, g, or t
  modified_base (316)..(316): a, c, t, g, unknown or other
  misc_feature (316)..(316): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggagtcacagagactctcctgngcagcctcgtgggttcaccttcagtagctacggcatgcacgtgggcccncaagcctccgaggcaaggggnttgggaggtggggtggctaggtttgttcagtcgtggacgggctaggtgttacaagtggtatggacagactccggtagaaacggggtccctattcaccgtactcctaccgagaacgaacaacttaccgaaggtaaaccaaactaagttagttaaagtttaggaaaacttagaaactaacgtaccttaaagtccgtagaacggtaacgtacgggtagtaacgtaacgttaacgtacggtaaacggaaacggggaacgggggaaaccgacgggacgggtacgttaccgaaacggttaccttaccgtttacggacggttcggtacgggggaccgtaaccgggg

SEQ ID NO: 357723 - DNA, 592 bp, Homo sapiens
  misc_feature: GZ8MTXP02IW3IW.10.44.D11.1.454.CMB.2.raw
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagatgtgtccagtgtcaagtgcaactggtggagtcgtggggggaggcgtggtccaggcctggggaggtcacagagactctcctgtgcagcctgtgggttccaccttcagtagctacggcatgcacgtgggcccnccaagctccgaggcaagggnttgggagtggggtggctaggttgtttcatcgtggagggctagtgttcaagttggtatgacagactccggtaggaaacgggccgtagttacacctagtcctacctagacgactaacttacccgaaggaactaacaattagtaattaggaaatagaacagacctaagtctagaggacgtacgggtagtatacgtactaggtaacggaaaggggacggggaaccaggacgggtagtaaccgaagtacgttccgttagaccggtcgtacggggtaccg

SEQ ID NO: 357724 - DNA, 765 bp, Homo sapiens
  misc_feature: GZ8MTXP02I7N1Q.10.44.D11.1.454.CMB.2.raw
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtcgtccagtgtcaagtgcaactggtggagtcgtgggggagcgtggtccagcctgggaggtcacagagactctcctgtgcagcctgtgggtcaccttcagtagctacggcatgcacgtgggtccnccaagctccgaggcaagggnttggagtggggtgctagtttcgtttcatcgtggacgggtcagttgtacaagttgggtatggcaggtacctccggtaggaaacggggtcctattaccacctacttccgtaccgaagacgtaaacctaacgttaccgaaacggaaaccaaacgtaaagttacggtttaaagtttaaacgggtaaaattacgaaaaccgtacgggtaaccccttaaacggtacccgtaagggaacgggtaaacggtaccgggggttaagtaaacgtttaaccgtaaaccggttaggttaaaacccggggtaaacggggggtaaaaccggggggaaacccgtaacgggggacccgggggttaaaccggtttaaaccccggtaaaacggtttaaccccgtttacccggttttaacggtaaccgggtttacccgggttaccgggggtacccggtttaaaccccggggg

SEQ ID NO: 357725 - DNA, 690 bp, Homo sapiens
  misc_feature: GZ8MTXP02JWHLN.10.44.D11.1.454.CMB.2.raw
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggagtcacagagactctcctgtgcagcctcgtgggttccaccttcagtagctacggcatgcacgtgggtccncaagctccaggcaagggnttggaggtgggtgctagtttgtttcatcgtggacgggctagttgtacaagtggtatgacagaccgttccgtgaaacggggtcctagttcaccctatcctaccgaagacgtaactaacttacccgaacggaaaccacgtaaagttaggttaagttttaaaggaaaattaacgggaaacctacggggtaacccttaaacgttacccgtaaggtaacgggaacccgtaagggggttataaaacgtacgttaaaccggtaagggttaaaccgggaaagggggtaaccgggggaaacgtacggggtaccggggtaacgttacccgtaaaggttccgttaccgtttacggaacggttccggtcggggacccgttaaccggggg

SEQ ID NO: 357726 - DNA, 661 bp, Homo sapiens
  misc_feature: GZ8MTXP02IYJXL.10.44.D11.1.454.CMB.2.raw
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcctgtgcagcctntgggttcaccttnagtagctacggcatgcacgtggcccncaagctccaggcaagggnttggagtgggtgctagttgttcatcgtggacgggcagtgttacaagtggtatgcagtaccgtccgtaggaacggggtccattccgacctactcctaccagacgaactaatacccgaagaaaccacaaagttagtaagtttaagggaaaacttggaaacctaacgggtaccctaaacgttcccgtaggaacgggacgtaacgggggttataaacgtacgttaacggtacggtaaaccggggaaagggggtaacgggggaaacccgaggggtaccggggaagtttacccgaaacggttacccgttaccgtttacggtaaccggttccggtacggggtacccgtaaaccggggg

SEQ ID NO: 357727 - DNA, 578 bp, Homo sapiens
  misc_feature: GZ8MTXP02FW8JA.10.44.D11.1.454.CMB.2.raw
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcctgtgcagcctcgtgggttcaccttcagtagctacggcatgcacgtgggtccnccaagctccgaggcaagggnttggagtgggtggctagtttgttcatcgtggagggcagtgttcaatggtatgcagactcgtgaagggccattcaccatctaccagagacaacttccaaggaacacaatagtaatttaggaaatagaacacgacctaacgtcctaggacggaacgacgggtagtaactactacgtaggtaacggaaacggggaacgggggaacctacgggacgggtagttaccgaagtacctacgttcggacgtcggtcggggacgtaccgggg

SEQ ID NO: 357728 - DNA, 595 bp, Homo sapiens
  misc_feature: GZ8MTXP02FY5JV.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagattctcctgtgcagcctctgggtcaccttcagtagctacgcatgcactgggtccgcaagctccaggcaaggggattggagtggggtgcagtttgttcatcgtggagggcagtgttacaagttggtatcggcaaggtacttcgtaggaaacggggcccgtaattccaacctaatcctaccagaagaacaattaccgaaggaaacaacaaatagtaatttaggaaaatagaaacacgacctaaagtccgtagaacggacacggggtagtaatactaacgtaggtaaacggaaagggggaacgggggaaccaggacgggacgtaccaagtactccgttagacgtcgtacggggcgtaacgggg

SEQ ID NO: 357729 - DNA, 757 bp, Homo sapiens
  misc_feature: GZ8MTXP02G2W0P.10.44.D11.1.454.CMB.2.raw
  modified_base (304)..(304): a, c, t, g, unknown or other
  misc_feature (304)..(304): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggagcgtggtccagccgtgggagtcacagagactctcctgtgcagcctcgtgggttcaccttcagtacgctacggcagtcgaccacgtcggggtcccnccgaaggcctaccgaggcaaaggggtattggggaggttggggtggctaggtttgttcagtcgtggaggggctaggttcgttacaagttggtaatcggacaggtaccgttccggtagggaacgggtccgtaatttccgaacctactaccgtaccgaacggtaacgtaacctaaacgttacccgaacgggtaaaaccaacgtaaaacgttacggtttaaggttttaaaggaaaacgttaacgtaaaccgtaacgtacccgttaaacggttacccgtagggtaacggaacggtaacggggttaagttaaacgttaacgttaaacgtacgggttaaacgggaaagggggtaaacgggggaaaccgacggggaaccggggttaacgttaacccggaaaaggtttccgttaccggtttacggaccggttaccggtaccgggggaccgtttaaccggggg

SEQ ID NO: 357730 - DNA, 557 bp, Homo sapiens
  misc_feature: GZ8MTXP02IJG6T.10.44.D11.1.454.CMB.2.raw
  modified_base (370)..(370): a, c, t, g, unknown or other
  misc_feature (370)..(370): n is a, c, g, or t
  modified_base (421)..(421): a, c, t, g, unknown or other
  misc_feature (421)..(421): n is a, c, g, or t
  modified_base (442)..(442): a, c, t, g, unknown or other
  misc_feature (442)..(442): n is a, c, g, or t
  modified_base (472)..(472): a, c, t, g, unknown or other
  misc_feature (472)..(472): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggaggcgtggtccagccgtgggaggtcacagagactctcctgtgcagcctgtgggttcaccttcagtagctaacggcatgcacgtgggccgccaaagctccaggcaagggattggagtgggtggctaggttgttcatcgtgagggcagtgttacaatggtatggnagacttccgagacgggcctatcacatctcagacacgaattcgaagaaacanaatagtattaggaaatagaanagacctaaagtcctagagacgaaggtgtanaacgtactaggtaagaaggacgggggaaaccgaggcggtaacgtcaaacgtactaccgtttacgacgtcgtacgggtacaccggg

SEQ ID NO: 357731 - DNA, 745 bp, Homo sapiens
  misc_feature: GZ8MTXP02GQZUM.10.44.D11.1.454.CMB.2.raw
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctcgtgggttcaccttcagtacgctacggcatgcacgtgggtcccnccaagcctccgaggcaaggggtnttgggagtgggtggctaggtttgtttcatcgtggacggggtctagttgtacaagttggtatggacaggtacccgttccgggtagggaaacggggtccctaagtttacccacctaacgttcccgtaccgaaggaacgtaaccgtaaactttacccgaaagggaaaccaccgtaaaagttaggttaaagttttaaaggggaaaatttaggaaaaccgtagggtacccttaaaacggttcccgttagggaacggtaacggtaccggggttagtaacgttaaccgttaacggttaacgggttaaacgggaaacgggggtaacggggggtaaacccgaacggggtaccggggttaacgttaacccgaaacggttaaccgtttccgttttaacggaccggtttcggtaccgggggtacccgttaacccggggg

SEQ ID NO: 357732 - DNA, 817 bp, Homo sapiens
  misc_feature: GZ8MTXP02GXVMH.10.44.D11.1.454.CMB.2.raw
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggaggtcacgagagactctcctgtgcagcctcgtggttcaccttcagtacgctacggcagtgacctacgtcgggtccccgacctaagcctaccgaggaccgtaaaggggtattgggaggttggggtggcttaggtttcgtttaccagtcgtaggacggggtctaggttcgttacgaaagttggtaatcggacaacggtaccgtaccggtaggaaacgggtccctattaccacctacgtcctaccgaagtaacgaaacgtaaacgttcccgaaacggtaaaaccaaacgtaaagttagttaaagttttaaagggaaaaacgttcgaaaaccgttaaccggtaaacccgttaaaaccggttacccgttaaagggaaacgggtaaccggttaaacggggttacgtaaaacgtttaaccgtaaaaccggtttaaaggggtaaaacccgggaaaagggggtaaacccggggggaaaaccgtacgggggtaaaacccgggggttaaccgtttaacccggaaaacggtttacccgtttacccggtttacggtaaacccggttcgggtttacccgggggacccgtttaaaccccggggg

SEQ ID NO: 357733 - DNA, 738 bp, Homo sapiens
  misc_feature: GZ8MTXP02HDHAW.10.44.D11.1.454.CMB.2.raw
  modified_base (299)..(299): a, c, t, g, unknown or other
  misc_feature (299)..(299): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccaggccgtgggagtcacgagagactctcctgtgcagtcctcgtgggttcaccttcagtagctacggcatgcacgtcgggtccnccaagcctaccgaggacgaaggggtatgggaggtggggtgctaggtttgttcatcgtggacgggtcagttgttacaagttggtatggacaggtaccgtcgggtaggaacggggtcccgtaacttccgaaccgtactttacccgaacccgaaggaaccgtaactaaaccgttacccgaaagggtaaaaccctaaacgtaaagttacggttaaagtttaaaggggaaaacttaacgaaaaccgtaacggtaaccgttaaacggtccgtaagggtaacgggtacgtaacgggggttattaaacgtaccgttaacggtacggtaaacggggaaacgggggaaacgggggtaaaccgtacggggtaaccggggtacgttaaacccgaacggttaccgttccggttacggtaccggttaccggtcgggggtacccgtaaccgggg

SEQ ID NO: 357734 - DNA, 540 bp, Homo sapiens
  misc_feature: GZ8MTXP02G8W8Z.10.44.D11.1.454.CMB.2.raw
  modified_base (253)..(253): a, c, t, g, unknown or other
  misc_feature (253)..(253): n is a, c, g, or t
  modified_base (285)..(285): a, c, t, g, unknown or other
  misc_feature (285)..(285): n is a, c, g, or t
  modified_base (319)..(319): a, c, t, g, unknown or other
  misc_feature (319)..(319): n is a, c, g, or t
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (422)..(422): a, c, t, g, unknown or other
  misc_feature (422)..(422): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagcctgggagtcacagagactctcctgtgcagcctntgggttcaccttcagtagctacggcatgcacnggtccgcaagctccaggcaaggatgggagtgggngctagttgttcatcgtgaggcagtgtcaagtggatgcaggactcgtagaacggtccgatcacatcacagananactacagaacacatatagttagaatagaanagactaacgtacgacgagaacgaggtagtactactactagtaggaaacgggaaggggaacggacggacgggacgtacgtaacgtacgtaccttagtacgtacgtcgggcgtaaccggg

SEQ ID NO: 357735 - DNA, 757 bp, Homo sapiens
  misc_feature: GZ8MTXP02FTK2O.10.44.D11.1.454.CMB.2.raw
  modified_base (323)..(323): a, c, t, g, unknown or other
  misc_feature (323)..(323): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggaggcgtggtccagcctggggagtcacagagactctctgtgcagcctcgtgggtcacttcagtagctactgcatcgcacgtcggggcccaccaagcctaccgaggacgaaggggtnttggggaggtggggtggctagtttgttcatcgtggagggctaggttcgttacaagttggtagtgaccgtaaggtacccgttccgggtaggaaaccgggggtccgtaactttccgaaccctacgtcccgtacccgaaggaaacgtaacctaaacgtttacccgaaagggtaaaaccctaacgtaaaagtttaggttaaagttttaacggggaaaattacggaaaacgtacggtaaccccgtttaaaggtacccgtaagggtaaaccgggaaccgttaacgggggttacttaaaacgttaaccgttaacggttaaagggttaaaccggggaaagggggaaacgggggtaacccgtaaggggtaccggggtaacgttaacccgtaaacgtttaccgttaccgtttacgggaacccgttcgggtacggggtaacccgg

SEQ ID NO: 357736 - DNA, 734 bp, Homo sapiens
  misc_feature: GZ8MTXP02FKZ1A.10.44.D11.1.454.CMB.2.raw
  modified_base (319)..(319): a, c, t, g, unknown or other
  misc_feature (319)..(319): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagccgtgggaggtcacagagactctcctgtgcagcctcgtgggttcaccttcagtagctacggcatgcacgtgggtccgccaagctccgaggcgaaagggtnttgggaggtggggtggctaggtttgtttcagtcgtggacggggtctaggtcgttacaagttggtaatgactaaggtaccgttccggtaggaaacggggcccgtaattaccacctactccgtaccaagaacgtaacaacgttaccgaaaggaaaccaaactaaagttagttaaagtttaaggaaactacggaaactaacggtaaccttaaacggtacccgtaggaacgggtacggaaccggggttagttaaacgttaaccgtaacgttacgggttaaaccggggaaagggggaaacgggggggaaacccgaacgggggtaccggggtaacggtttaacccggtaaacggttaacccgtttaccggtttacggtaccgggttaccgggtaccgggggtacccggttaaacccggggg

SEQ ID NO: 357737 - DNA, 647 bp, Homo sapiens
  misc_feature: GZ8MTXP02HRMB8.10.44.D11.1.454.CMB.2.raw
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggaatcgtgggggaggcgtggtccagccgtgggaggtcacgagagactctcctgtgcagtcctcgtgggttccacccttcagtagcctacggcatcgcacgtcgggtcccncaagcctcgaggcaagggnttggaggtggggtgctaggtttgtcagtcgtggacgggctagttgtacaagttggtatcggactaacggacccccggtaggaaacggggtccaattcccgacctactccgtaccaaggacaactaacttccgaaagtaaccataacttgtaatttaggaaatggaaacacgtacctaagtccgtaggacggacgtacgggttagtaataacgtacgttacggaaacggaagggggtacggggaaccgtagggacggtacgttacccgaaagttcccgttacggttacgaccggttacgtcgggggtacccgtacgggttacccg

SEQ ID NO: 357738 - DNA, 794 bp, Homo sapiens
  misc_feature: GZ8MTXP02IJ7UF.10.44.D11.1.454.CMB.2.raw
  modified_base (300)..(300): a, c, t, g, unknown or other
  misc_feature (300)..(300): n is a, c, g, or t
  modified_base (326)..(326): a, c, t, g, unknown or other
  misc_feature (326)..(326): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggagcgtggtccagccgtgggagtcacagagactctctgtgcagcctcgtcgggttccaccttcagtagctacggcatgcacgtcgggtcccnccaagcctccgaggccgaaaggggtnttgggaggtggggtgtctaggtttgtttaccattcggtaggacgggtctagttcgttacaagttgggtatggactaggtaccgttacccggtagggaaacggggtcctaatttccaccgacttaccgaccgaagtaacgtaaacgtaaaccttaaccggaacggtaaaacctaacgtaaacgtttaaggtttaaacggtttaaaggaaaacgttacggtaaacgtacgttaaccccgttaaacggtacccgttagggaacgggtaaccggtacggggttaacgtaacgttaaccgttaaacggttacggtaaacgggggaaacgggggtaaaccggggggaaacccgtacgggggtaaacccggggttacgtttaaaccccggtaaaacggtttacccgtttacccggttttacggggtacccgggtttaccgggtttaccgggggtaaccccgtttaaacccggggg

SEQ ID NO: 357739 - DNA, 610 bp, Homo sapiens
  misc_feature: GZ8MTXP02F1QCQ.10.44.D11.1.454.CMB.2.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (347)..(347): a, c, t, g, unknown or other
  misc_feature (347)..(347): n is a, c, g, or t
tcagcatagtagtgcacgaccggtgctcgatttagcgcagtacgaaggggaggaactgctcagttaggacccagagggaaccatggaagccccagctcagcttctcttcctcctgctactctggctcccagtttcagataccaccggagagattgtgttgacacagtctccagccaccctgtcttttgctccgaggggaaangccaccctctcctgcagggccagtcagagtgttggcncctagngcctggtaccaacagaaacctggccaggctcccaggcccctnatctatggtncatccaagngggccactggcatcccagccagtcagtgcagtggctggacngacttcactctcaccatcatcagcctggagcctagaagtatgttgactagtttacttactagtacaaacgtataccgtacgtacggtcggtacccgtccgggggtaccctaccggtttccggcccgtttacggggaaaccctaaaagggtcggtaacgttaaacgtaaccgtaaaacggtaaaccgttggttacggcccgttaggaacccgtaacccgtaatttacccgttcggtttaccgtttaaccgtacttttcccccgg

SEQ ID NO: 357740 - DNA, 718 bp, Homo sapiens
  misc_feature: GZ8MTXP02GKUPQ.10.44.D11.1.454.CMB.2.raw
  modified_base (297)..(297): a, c, t, g, unknown or other
  misc_feature (297)..(297): n is a, c, g, or t
  modified_base (312)..(312): a, c, t, g, unknown or other
  misc_feature (312)..(312): n is a, c, g, or t
  modified_base (323)..(323): a, c, t, g, unknown or other
  misc_feature (323)..(323): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggaggcgtggtccagccgtgggaggtcacagagactctcctgtgcagcctctggttcaccttcagtagctacggcatgcactcgggtccnccaagcctaaaccgnggaccaagggntggagtggggtgctagtttgttcatcgtggacggcagttgtacagtggtatgcaagaccttccggtagaacgggcctatccgacctactcaccagacactaacttccaaaggaacacaaagttgttaaagtttaggaaattacgaaacgacgtaacctaacgtaccgtagaaccggtaacgtacgggttacgttaaactaaccgttaaacggtaacggttaaaccggggaaaacgggggtaaaccggggggaaaccgtaaacgggggttacccgggtaaacggggttttaacccccgtaaaaacgggtttacccgttttaacccgggtttaaaccgggttacccgggttaccgggggtaacccgggggttaacccgggtttaaaacccccggggg

SEQ ID NO: 357741 - DNA, 735 bp, Homo sapiens
  misc_feature: GZ8MTXP02H9CO3.10.44.D11.1.454.CMB.2.raw
  modified_base (280)..(281): a, c, t, g, unknown or other
  misc_feature (280)..(281): n is a, c, g, or t
  modified_base (382)..(382): a, c, t, g, unknown or other
  misc_feature (382)..(382): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggagcgtggtccagccgtgggagtcacagagactctcctgtgcagcctgtcggttcaccttcagtagctacggnngtcgactacggtccggtccacgacgccgtacgaggtacggaaggtggtggtagggtggtcgtagttggtttgtactacgtcggtaggcccggtacgtgttntaacgtagttgtagtcgtacgaacgtccggtacgaaggggtaccggtctaccgtacccactcccttaccgacgagtaacgtaaactaccgttaaaccgaagaaaccgtaacgtaagttaggttaagttaaaaggtaagtaaaccgtaacgacgttaaccgtaaccgttacggtaaggtaacgggtaaccggtggttaaacgtaacgttaaccgttaacggtaacggtaaaccggggaaaacgggggtaaccgggtaacggtacggggtaaccggtttaccgtaaaccggtaacgtttacccgttacggttaacggtaccggtaccggggtaacggtacccggtttaacccggg

SEQ ID NO: 357742 - DNA, 685 bp, Homo sapiens
  misc_feature: GZ8MTXP02GLE7J.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacgagagactctcctgtgcagcctcgtgggttcaccttcagtagctacggcatgcacgtcgggtccaccaagcctaccgaggcgaaaggggtattgggaggttggggtggctaggtttgtttcagtcgtggacgggctagttgttacaagtggtatcgcgaagtaccgtccggtaggaaacgggtcctaattaccgacctactcctaccagaacgaactaacttaccgaacggaaacactaagttagttaagtttaaggaaaattacgaaactaacgtacccgttaaacgtcccgtaaggaacggtaaccggtacggggttagtaacgttaaccgttaacgtacgggtaaacgggaaacgggggaaacgggggaaaccgacgggaccgggtaacgttacccgaaagttacccttaccgtttacggaccgttcggtacggggtacccgtaaccgggg

SEQ ID NO: 357743 - DNA, 672 bp, Homo sapiens
  misc_feature: GZ8MTXP02I6K81.10.44.D11.1.454.CMB.2.raw
  modified_base (330)..(330): a, c, t, g, unknown or other
  misc_feature (330)..(330): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactctcctgtgcagcctcgtgggttccaccttcgagtacgctacggcatcgcacgtcgggtcccgccaagcctccgaggacgaaaggggtnttggggaggttggggtgacttaggtttcgtttacagttcgtagggacggggtactaggttgttacgtaagttggttaatcggacaggtaccgtccgggtaagacggggcctattccacgtactcctaccgaagacgtaactactcgaaagaaccaactaattagtaagttaggaaattagaaacacgtaactaacgtccgtaggaacggacgtacgggtataactaccgtagtacgggtaaaccggaagggggaaacggggaacgtacgggacggggttaaccgtaccgtaacggttaccgttcgttacgggccgtacggtacggggtacccgtaaccgggg

SEQ ID NO: 357744 - DNA, 898 bp, Homo sapiens
  misc_feature: GZ8MTXP02IZBJ8.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgtgttttcctcgttgcttcttttaagaggtgtccagtgtcaagtgcaactggtggagtcgtgggggaggcgtggtccagccgtgggagtcacgagagactctcctgtgcagcctcgtggttcaccttcagtagctacggcagtcgccacgtcgggtccccaccaagcctaccgagggaccgaaaaggggtgtttgggaggttggggtggtctaggttttcgtttacagttcgtagggagggtcctaggttcgtttacaaaggtttgggtacttcggaccgtaacggtacccgtttcccgggggaaggggtaaaccgggggtcccctaaacgtttacccgaacccgtaacttcccgtacccggtaaacggtaaaccggtaaacccttaaaaccgtttaccccgggaaaacggtaaaacctaaaccgttaaaagtttacggttttaaaaggttttaaagggtaaaacgttaacgggtaaaaccgtaacccggttaaccccgtttaaaacggttacccggttaaggggaaaccgggtaaaccgggtaaccgggggtttaaaggtttaaacctttaaaccgtttaaacccgggttaaacggggtaaaaccgggggtaaaaacgggggtaaaaccggggggaacccgtaaacggggggtaccggggttaaaaccggtttaaccccgtaaaacggtttacccgtttacccggttttaacggggtaaccccggtttccggggttaccgggggttaaccccggg

SEQ ID NO: 357745 - DNA, 702 bp, Homo sapiens
  misc_feature: GZ8MTXP02GUW7T.10.44.D11.1.454.CMB.2.raw
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggcttaactgggttttcctcgttgctcttttaagaggtgtccagtgtcaagtgcaactggtggagtcgtgggggaggcgtggtccagcctgggaggtcacagagactctcctgtgcagcctctggttcacttcagtagctacggcatgcacgtgggcccncaagcctccaggcaagggnttgggagtggggtgctaggtttgttacagtcgaggaggcctagtgttacaagtggtaatgctacgactccggtaggaacgggtcctattacccaccgtatcccgtacaggaacgactaaacttcccgaaaggtaaaccaactaaagttagttaaacgtttagggaaaacttacgggaaaactacggtaaccccgttaaagtcccgtaagggaacggtaacgaacgggggttataaactaccggttaacgtagggtaaaacggggaaagggggaaaccgggggaacccgaaggggtaccggggtaaacgtttaacccgaaacggttaacgttcccgtttaagggaccgggttaccggtacgggggtacccgttaaacgggggtttaccccg

SEQ ID NO: 357746 - DNA, 586 bp, Homo sapiens
  misc_feature: GZ8MTXP02I6AVU.10.44.D11.1.454.CMB.2.raw
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
  modified_base (359)..(359): a, c, t, g, unknown or other
  misc_feature (359)..(359): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcctgtgcagcctctgggttcaccttcagtagctaacggcatgcacgtgggtcccnccaagctccgaggcaagggtnttggagtggggtgctaggtttgttcatcgtggacgggctaggtnttacaagtggtatgcagactccggtagaacgggcccgtattccactactcctaccagagacacttaccgaaggaacacgaattagttaatttaggaaaattagaaacagtacctaaagtccgtaggacggtacgacgggtagtacgtactacgtaggtaacggaagggaagggggaaccacggacggacgtacgaagtactcgttacgacgtcgtacgggcgtacgg

SEQ ID NO: 357747 - DNA, 793 bp, Homo sapiens
  misc_feature: GZ8MTXP02I6TM7.10.44.D11.1.454.CMB.2.raw
tcagcatagtagtgcacgaccggtgctcgatttagcgcagtacgaagggggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggaggcgtggtccagccgtgggagtcacagagactctcctgtgcagcctcgtggttcaccttcagtagctacggcatgcacgtcgggtccaccaagcctccgaggacgaaggggtattggggaggtggggtgcgttaggtttgttacagtcgtggacggggtctaggttgttacgtaagttgggtatcgggacgaacggtaccgttccgggtaggaaacgggggtccctaacgttaccaccgtacttccgtaccgaagtaaccgtaaactaaccgttaaccgaaacggtaaacctacgtaaagtttagttaaaggtttaaaggaaaacgttacgaaaaccgtacggtaacccgttaaacggttcccggtaaagggtaacgggtaaaccggttacggggttaacgttaaacgttaaccgttaacgggttaacggggtaaaaccgggggaaaacgggggtaaaccggggggtaaaacccgacgggggtaaaccggggttaaccggttaaacccggtaaacggttacccgtttaaccggtttaccgggtaccgggttaccgggtaccgggggtaccccgtttaacccggggg

SEQ ID NO: 357748 - DNA, 693 bp, Homo sapiens
  misc_feature: GZ8MTXP02HRJCA.10.44.D11.1.454.CMB.2.raw
  modified_base (275)..(275): a, c, t, g, unknown or other
  misc_feature (275)..(275): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaagtggtggagtcgtggggggaggcgttggtccaggcctgggaggtcacagagacctctcctgtgcagtcctcgtgggttcaccttnagtagctacggcatgcacgtcgggtccgacaagcctaccgaggcaaggggtgttggagggtggggtggtctaggtttgtctagtcgtaggacgggctaggttgtactaagttggtatggactaagaccgtcggtaggaacggggcctagttaccacctactacctaccgaaggacgtaacctaaacgttaccgaacggaaactaacgtaaagttaagttaagtttaaggaaagttaacgaaacgtaacgtaccgttaaacgtccgtaaggtaacggaacgtaacgggttagttaactaacgttaacggtaggttaaacgggaaacggggaacgggggaaccacgggacgggtaacggtaccgtaaacggttcgtaccgtttacggaacggttccggtacggggtaccgttaaccgggg

SEQ ID NO: 357749 - DNA, 740 bp, Homo sapiens
  misc_feature: GZ8MTXP02IIHJZ.10.44.D11.1.454.CMB.2.raw
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
tcagcatagtagtgcacgaccggtgctcgatttagcgcagtacgaaggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaangccacctctcctgcagggccagtcagagtgttggcgtcctagtagcctggtaccaacagaacctggaccaggcctacccgacggcccctctacnctactaggtggcactaccaccgaacggccgatcggtcgactccacgcgacgttagcgtggtccgagtgggtcgtcggacgacgtctcgtactccgtacgacccacgtactacttaccgacgcccgtaccggtagaccggtacgttaaaggtaaacgttggttacggttaccgttagttttaaacggtttactaccgttaggtaaaccttaacgttaccggtaccccgggttaaaggggtccgggttccccggttaccccggggggtccggttaacccggttttcccgggtaccccggttaaccggggtaaccgggtaaaaccggttaacggggttactaaaaccgggttactaaaaaacccgggtaaccggttagttaaccggggcgttaacccgcggtaaccccttacgtaccgttacggtccttttaactacccgtttccccg

SEQ ID NO: 357750 - DNA, 771 bp, Homo sapiens
  misc_feature: GZ8MTXP02IUDR8.10.44.D11.1.454.CMB.2.raw
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgctcttttaagaggtgtccagtgtcaagtgacaactggtggagtcgtgggggagcgtggtccagccgtgggagtcacagagactctcctgtcgcacgcctcgtggtcaccttnagtanctacggcatgcacgtcggccaccagcctcgaggcgaagggtatgggagtggggtgtcgttagtttcgtttcgatcgtggaccgggtctagggttcgttacgtaaggttggttaatcgggtacgtaacggtacccgttaccgggtacggggtaaacgggtcccgtaactttccccgaaccgttacgtaccgtaaccccgaagtaacccgtaaacctaaacttaccgaaacggaactaacgtaaagttacgttaaagtttaaacggaaaatacggtaaactacggtaacccgtaaacgtccgtaacggacgggtaaccgtagggttagttaaacgtaaccgttacggtaacgggttaaaacgggaaacgggggaaaccgggggaaccgtacgggggtaaccggttaacggttaacccgttaaaaccggttcccggtttaacggtttaccggtaacccggttccgggtttaacccgggggtaacccgtttaacccggggg

SEQ ID NO: 357751 - DNA, 763 bp, Homo sapiens
  misc_feature: GZ8MTXP02HMJPP.10.44.D11.1.454.CMB.2.raw
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaagtggtggagtcgtgggggagcgtggtccaggcctgggagtcacagagactctcctgtgcagccctgtgggttcaccttcagtagctacggcatcgcacgttcgggccgaccctaagccctaccgaggaccgaaaggggtagttggggaaggttcggggtggcttaggtttgtttaccgagtcgtaggacggggtctaaggttgttacgaagttgggtaatcgacgtaaggtacctaccggtagggaacgggcctacttaccaccgtactctaccgaagaacgtaacaacttacccgaaaggtaaaccaacgtaaagtttaaggttaagtttaaagggtaaaacttaagaaaccgtaacggtaaacccgttaaacgttacccggttaagggtaaacccgggaacggttaaaccgggggttatttaaaaccgtaaccgtttaacggtacggggttaaaccgggaaaaggggtaaacggggggaaaccgtacggggtaacgggtaaccgtttaacgaaacggtttaccttaccggtttacggaccggttccggtacggggtaccgttaacccgggg

SEQ ID NO: 357752 - DNA, 574 bp, Homo sapiens
  misc_feature: GZ8MTXP02H3KI7.10.44.D11.1.454.CMB.2.raw
  modified_base (293)..(293): a, c, t, g, unknown or other
  misc_feature (293)..(293): n is a, c, g, or t
  modified_base (378)..(378): a, c, t, g, unknown or other
  misc_feature (378)..(378): n is a, c, g, or t
  modified_base (469)..(469): a, c, t, g, unknown or other
  misc_feature (469)..(469): n is a, c, g, or t
tcagcatagtagtgcacgaccggtgctcgatttagcgcagtacgaagggggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtggtccagcctgggaggtcacagagactctcctgtgcagcctcgtgggttcaccttcagtagctacggcatgcacgtggtccnccaagctccgaggcaagggattggagtcgggtagctagttgttcatcgtgacggggcagtgtacaatcggtatgcagtactcganaaggggcccatcaccatcctacagagacaattccaaggaaacacaaatgtatttaggaaatgaaacagacctaagctagagacacgggttntaactacgtactagtaacggaaagggacgggggaaacccgtagacggggtaacttaccgaaacgttacgtaccgtttgacggtacgttcgggggacctacggggg

SEQ ID NO: 357753 - DNA, 711 bp, Homo sapiens
  misc_feature: GZ8MTXP02GT4Q1.10.44.D11.1.454.CMB.2.raw
  modified_base (299)..(299): a, c, t, g, unknown or other
  misc_feature (299)..(299): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggagcgtggtccagccgtgggagtcacagagactctcctgtgcagcctcgtgggttcaccttcagtacgctacggcatgcacgtcgggtccnccgaagcctccgagggacgaaggggtattggggaggtggggtggactaggtttcgtttacagtcgtaggacggggtctaggttgtacaagttggtatcggcaacggtccgtaccggtggaaacggggtcctattccgacctactcctacgaacgtacgaacctaaacgttccaaacggtaaaccaactaaattaggttaaatttaaggggaaaacttagaaaacgtacggtaaccctaaacggttcccgtaaggaacgggtaacggtacggggttagtaactaaccgttagtacgggtaaacggggaaacgggggaacgggggtaaaccgacggggtacgggaacgtttaccgaaacgtttacgtaccggttacggtaccggtacggtaccgggggtaccgtttaaccgggg

SEQ ID NO: 357754 - DNA, 539 bp, Homo sapiens
  misc_feature: GZ8MTXP02IY00S.10.44.D11.1.454.CMB.2.raw
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
  modified_base (421)..(421): a, c, t, g, unknown or other
  misc_feature (421)..(421): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctctgggttcaccttcagtagctacggcatgcactgggtccnccaagctccaggcaagggnttggagtgggtgctagttgttcagtctgagggcagtgtcaatggtangcagactccgngaacgggccatcacatctcaganactatcagaacanatagtattagaatgaanagactaacgcgtagacgacgacggtagtatacgtacgtaggtacggaagggacggggaacacggacggtacgttacgaacgttacgtcgttacggacgtcgtcgggtaccgtaccggg

SEQ ID NO: 357755 - DNA, 688 bp, Homo sapiens
  misc_feature: GZ8MTXP02HIYSF.10.44.D11.1.454.CMB.2.raw
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggagtcacagagactctcctgtgcagcctcgtcgggttcaccttcagtagctacggcatcgcacgtcgggtccaccgaagcctccgaagggaccaaaggggtacttggggagtggggtggtcgtagtttcgttcagtcgtggacggctagtgttacagtggtatgcagtaccgtcgtaggaaacggcctatccacctatcctaccaagaacgtaccaaagttcccgaaaggtaaacctaacaaagttagttaagtttaaggaaaacttacgaaactacgaacccttaaagtcccgtaggaacggaacggtacgggttacgtaagtaaccgtaacgtacgggtaaacgggaaacgggggtaaacgggggaaaccgacggggtaccggggtacgttaacccggtaaacggttaccttaccggtttaaccgacggttaccggtaccgggggtaaccctaccggggg

SEQ ID NO: 357756 - DNA, 683 bp, Homo sapiens
  misc_feature: GZ8MTXP02HET4X.10.44.D11.1.454.CMB.2.raw
  modified_base (296)..(296): a, c, t, g, unknown or other
  misc_feature (296)..(296): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggaggcgtggtccagccgtgggagtcacagagactctcctgtgcagcctcgtgggttcaccttcagtagctacggcatcgcacgtgggccnccaagcctccgaggcaagggattgggagtggggtgctagtttgttcatcgtgacgggtctagttcgttacaagttgggtaatggcagaccgttcgggtagaacggggcctaagttccaccgtatccgtacagtacgaactaacttaccgaaggaaacactaagttagttaaacgtttaaggaaaagttagaaaaccgtaggtaaccccgttaaaggtacccgtaggaaccgggtacgtaacggggttagtaaacgttacgttaacggtacggttaacgggaaacgggggaaaacgggggaacccaaggggtaccgggtaaacgttaccgaaaaggttccgtaccgttttacgaacggttccggtacgggggtacccgtaacccgggg

SEQ ID NO: 357757 - DNA, 993 bp, Homo sapiens
  misc_feature: GZ8MTXP02H42WP.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcggtgggggagcggtggtccaggccgtgggagtcacgagagactctccgtgtagcacgtcccgttcgtcggggtttccacccttcgaggtacgaccgtacggcctaagtcgcctaccggttcggggtaccccgacccgaaagccccgttaccggaagggaccgaaagggggtaagttcgggggaaggggttgggggtcgggtaccgtttaagggtttttggtttacccgaagttccggtaggacccggggtaccttaagggtttacgttacgtaaaggtttggggttaacgtcggtaaccgtaaacggtaccccggtttaccgggggtaagggaaaaccccggggggtcccttaaaacgtttacccccgaaaccctaacgtttacccccgtaaccccggtaaaagggaaaccgtaaacccgttaaaaccgttaaccccggtaaaacggggaaaacccttaaaccgttaaaacgtttaacgggtttaaacggtttttaaaagggaaaaaccgtttaaaggaaaacccggtaaaccggttaaacccgttaaacggttaccccgtaagggaaaccgggtaccgggttaaaccggggttagttaaacgtaaaccccggttaacggttaaaacggggttaaccgggggaaaaacgggggttaacccgggggggaaaacccgtaagggggtaaccgggggttaaccgttaaaacccggttaaacggtttacccgttaaccggttttacggggacccggtttacgggtaccgggggttaaacccggttaccccggggg

SEQ ID NO: 357758 - DNA, 691 bp, Homo sapiens
  misc_feature: GZ8MTXP02FTC21.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagccgtgggagtcacgagagctctctgtgcagcctcgtggtcaccttcagtacgctacggcagtcgcacgtcgggtcccgacaagcctaccgaggtacgaaggggtattggggaggttggggtggactaggttttcgttacatcgtaggacggtctagttgttacaagttcggttaatcggacaggtaccgtaccggtaggaacggggccctagttaccaacctacgtccctaccgaaggtaaccgaactaacgttaccgaacggtaacaactaaagttacgttacgtttaaaggaaactacgaaactaacgtaccgttaaacgtcgtaggaacggtaaccggtacgggttataacgttaacgttaacgtacgggtaaacgggaacggggaaacgggggaacgacgggacggtacgttaaccgtaacgttaccgttcgttacggacgttccggacgggtacccgtaaccgggg

SEQ ID NO: 357759 - DNA, 832 bp, Homo sapiens
  misc_feature: GZ8MTXP02IK6J4.10.44.D11.1.454.CMB.2.raw
  modified_base (328)..(328): a, c, t, g, unknown or other
  misc_feature (328)..(328): n is a, c, g, or t
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtggtccagccgtgggagtcacgagagactctcctgtgcagcctcgtcgggttcaccttcgagtagctaacggcagtcgctacgtcgggtcccaccaagcctccgaggcgaaagggtnttggagtgggtgcttagtttcgtttacagtcgtggacggtactagttagttacgaagttggtaactcgggtaccaacggtacccgttaccgggtaggggaacggggtacctaaacgtttaccacctaacttcccgtaccgaagtaaaccgtactaaaccgttaaccggaaacggtaaaacccaagtaagttaacggtttaaagtttaaacggaaaacgttacggaaaaccgtacggttaaaacccgttaacggtccgttaaaggggaacgggttaaaccggtaacgggtttaataaaccggttaaaccgtttaacggggtaaacggggttaaaaccgggggaaaacgggggggtaaaccgggggtaaaacccgtacgggggttaaaacccggggttaccgtttaaaacccgggttaaaacggtttaccccgtttaacggtttttaaaccggggacccggtttaccggggttaacccgggggtacccgtttaaaacccccggggg

SEQ ID NO: 357760 - DNA, 635 bp, Homo sapiens
  misc_feature: GZ8MTXP02JZQTR.10.44.D11.1.454.CMB.2.raw
  modified_base (300)..(300): a, c, t, g, unknown or other
  misc_feature (300)..(300): n is a, c, g, or t
  modified_base (325)..(325): a, c, t, g, unknown or other
  misc_feature (325)..(325): n is a, c, g, or t
  modified_base (386)..(386): a, c, t, g, unknown or other
  misc_feature (386)..(386): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagccgtgggagtcacagagactctccgtgtgcagcctcgtggttccaccttcagtagctacggcatgcacgtcggggtcccnccaaggcctccgaggcgaaggggtnttgggaggtggggtgcgtagttcgttcagtcgtaggacggctaggtgttacaagttggtancgacgtaacggaccgtccgggaggaacgggcctatacccacgtactcgaccgtaagacgacaacgttccgaaagtaaacacgtaagtaggttacttaaaggaatacgaacgtacgtaacgttaacgtccgtaggacgggtaacgtacggggttactaagtaacgtaacgtaaggtacggaaggggtacggggacagggacggtacgttacgaacgttcgtacgtcgtaccggtcggcggacggtaccgg

SEQ ID NO: 357761 - DNA, 844 bp, Homo sapiens
  misc_feature: GZ8MTXP02FZM67.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggaggcgtggtccagccgtgggaggtcacagagactctcctgtgcagcctcgtgggtccaccttcgagtagcctacggcatcgaccgtacgtcggggtaccccaccgaacgcctaccgagggacgaaaggggtattggggaggttggggtgcgtaggttttcgttacagttcgtgggacgggtctaggttcgttacaaaggttggttaatcggaccgaacggtaccgttcccggtagggtaaaaccggggtcctaaactttacccgaaacccgtacgtaccgtaacccgaaggaacgtaaaccctaaacgttaccgaaacggaaaacctaactaaagttaggttaaagtttaaggaaaacttacggaaacctaacggtaaccgttaaaacggtccggtaagggtaaaccgggtaacggttaaccggggttaagttaaaccgttaacggtaaaccggtttaaggggtaaaacgggggtaaaaccgggggaaaacggggggaaaacccgtacgggggtaaaccggggttaaccggtttaaaccccggtaaaaccggttttacccgttaacccggttttaacggggtaacccggggtttaccgggtaaccggggggtaaccccgtttaaaccccggggg

SEQ ID NO: 357762 - DNA, 742 bp, Homo sapiens
  misc_feature: GZ8MTXP02JV9ZH.10.44.D11.1.454.CMB.2.raw
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggaggcgtggtccagccgtgggaggtcacagagactctcctgtgcagcctgtggttcaccttnagtgctacggcagtgcctacgtcggggtacccncaagcctaccgaggacgaaagggtgttgggacggttggggtggctaggtttcgttacagtcgtaggacgggtctaggttcgtacaagtgtatcgacgtagtaccgtcggtaaggaaacgggtcctattacccacctatcccgtacgaagacgaactaaccgtaaccgaacggaaacaacgtaaattaggtttaacttaagggaaaactacgaaaccgtaaccggtaaccgttaaacgtacccggtaggaaacgggtaccgtaaggggttagtaaacgtaccgttaacgggtacggtaaacgggggaaacgggggtaaaaccgggggaaccgtacgggggtaacccgggtaaacgtttaacccggtaaacggtttacccgtttaccggtttacgggaccggtttcgggtacccgggggtacccggtttaaacccggggg

SEQ ID NO: 357763 - DNA, 647 bp, Homo sapiens
  misc_feature: GZ8MTXP02HG7GW.10.44.D11.1.454.CMB.2.raw
  modified_base (352)..(352): a, c, t, g, unknown or other
  misc_feature (352)..(352): n is a, c, g, or t
  modified_base (374)..(374): a, c, t, g, unknown or other
  misc_feature (374)..(374): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactctcctgtgcagcctcgtcggttcaccttcagtagctacggcatcgctacgtcgggccaccaagctccgaaggcgaagggtatgggaggtggggtagctaggtttcgttanagtcgtggacgggtctaggttntacgaagttgggtaatcggacacggtaccgtccgggtaggaaacgggcctacgttaccactacttccaccgaagaacgaactaacttaccgaaagaaccaataagttagttaagttaagaaattagaaacgtacgtaaccgtaacgtacgtaggaacggaacgtacggtatactaacgtacgtaggtaaacggaacggggaacggggaacacgggaccgtaacgtacgtaacgtacgttcgttacggaccgtcggtacgggtaccgtaaccgg

SEQ ID NO: 357764 - DNA, 755 bp, Homo sapiens
  misc_feature: GZ8MTXP02FZFF7.10.44.D11.1.454.CMB.2.raw
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctgggagtcacagagactctcctgtgcagcctcgtggttcaccttcagtacgctacggcagtgccacgtcgggtccccacaaggcctaccgaaggcgaaggggtattggggaggttggggtagcctaggtttgttcagtcgtggaccggggtctaggttgttacaaagttggtactcgcgaacgtaccgtcccggttagggaacggggtcctacgttaccaccgtacttacccgtaccgaaggtaacgtaacgtaacgtttaacccgaaacgggaaacctaaagtaaacgtttaagtttaaagtttaaggtaaaacgtacgtaaaccgaacggtaaccgtaaacggttaccgttacgggaacgggtaaccggtaacggggttacgttaaacgtacgttaacggtacgggtaaacgggaaacgggggtaaacgggggaaacgtacggggtaccgggtaaccgtttaacggtaaacggttacgtttaccggttacggtaccggttaccgggtacggggtacccggttaacccggg

SEQ ID NO: 357765 - DNA, 674 bp, Homo sapiens
  misc_feature: GZ8MTXP02JY7X3.10.44.D11.1.454.CMB.2.raw
tcagcatagtagtgcacgaccggtgctcgatttagcgcagtacgaaggggggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggacgtcacagagactctcctgtgcagcctcgtcgggttccaccttcagtacgcgtacggcatgcacgtcgggcccaccgaagcctaccgaggacgaaggggtattggggaggttggggtacggcgttaggtttcgtttacacgttcggtaggacggggtctagttgttacaagtggtatggacacggtacctccggtagaacgggtcctaatccgaacctatccgtacaggacgtaactaaacttaccgaagtaaacacgtaattagttaagttaggaaactaggaaacacggtaactaaacgtaccgtaggaaccggacgtacggttgtaaactacgtacgtaggtaaacgggaaacggggtaaaggggaaccgtaggaccgggtacgttaacccgaaggttaccgttaccgtacggtaccggtcggtaccgggtaccgtaaccggg

SEQ ID NO: 357766 - DNA, 646 bp, Homo sapiens
  misc_feature: GZ8MTXP02GLT4V.10.44.D11.1.454.CMB.2.raw
  modified_base (267)..(267): a, c, t, g, unknown or other
  misc_feature (267)..(267): n is a, c, g, or t
  modified_base (315)..(315): a, c, t, g, unknown or other
  misc_feature (315)..(315): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggagtcacagagactctcctgtgcagcctctgggttcaccttnagtgctacggcatgcacgtgggtcccgccaagcctccgaggcaagggnttgggagtgggtgctagtttgttacatcgtggacggggctagttgttacaagttgggtaatggacaaggtaccttcccgggtaggaaacggggtccctattcgaacccatcctacagacgaactaacgttaccgaacggaacaactaagttacgttaagtttaggaaatagaaacaagtacccgtaaacgtccgtaggacggacgtaacgggtataacgtaactaacgtacggtaaacgggaaaggggaacgggggaaaccagggtaccggtacgttaccgaaacgttacgtaccgttacggaccggtcggtacggggaccgtaaccgggg

SEQ ID NO: 357767 - DNA, 839 bp, Homo sapiens
  misc_feature: GZ8MTXP02IJ63I.10.44.D11.1.454.CMB.2.raw
tcagcatagtagtgcacgaccggtgctcgatttagcgcagtacgaaggggggagaggagcccagcactagaagtcggcggtgtttccattcggtgatcagcactgaacacagaggactcaccatggagtttggctgaactgggttttcctcgttgctcttttaagaggtgtccagtgtcaagtgcaactggtggagtcgtgggggagcgtggtccagccgtgggagtcacagagactctcctgtgcagtccttgtcggttcaccttcgaagtacgccgtacggcagtcgactacgtcgggtccaccgaagcctaccgaggacgaaagggtagtgggaggtggggtgcttagtttgtttacagtcgtggacggactagtcgttacaagttggtatcgacgtacggtaccgttaccggtaggtaacgggaccttacgttacccacacttacccgacgaaggaacgtaactaaacgttccgaaacggtaaacaaacgtaacgttaggtttaaacgtttaaaggaaaacgttaacgaaacccgtaacggttaaaccccgttaaacgggttacccggtaaacgggtaaaccggggtaaccggttaaaccggggtttaacgtttaaaaccgtaaacccggtttaaacggttaaacgggggttaaaaccgggggaaaaccggggggtaaaaccggggggtaaaaccccgtaacgggggtaaaacccgggggttaaacgtttaaaccccgggtaaaacggttttacccgttaacccggttttaaacgggaaacccgggtttccgggggttaaacccgggggtaaccccggtttaaaacccccggggg

SEQ ID NO: 357768 - DNA, 713 bp, Homo sapiens
  misc_feature: GZ8MTXP02JLV2W.10.44.D11.1.454.CMB.2.raw
  modified_base (283)..(283): a, c, t, g, unknown or other
  misc_feature (283)..(283): n is a, c, g, or t
  modified_base (297)..(297): a, c, t, g, unknown or other
  misc_feature (297)..(297): n is a, c, g, or t
tcagcatagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacaggagtactctcctgtcgcagcctgtgggttccaccgttcagtagctacggnatgcacgtgggccncaagcctacgaggcgaagggtatggaggtgggtgacgtagtttgttccagtcgtggaccgggtctaggttcgttactaaggtcggtaatcggaccgtaggttacccgtccggtaggggaacggtccgtattccgacctactccgtacgagtaaacgaactaacgtccgaaacgaaacctaagaaagttgttaaacgttaaaggaaaactaggaaaccgtaacggtacccgttaaacgttacccgaaggtaaccggtaacgtaccgggggttataactaacgttaacggttacggaaacgggtaaacgggggaacgggggtaaaccgacggggtaaccggggtacgttaacccgtaacggttacccgtttaacgttacgggtaccggttaccgggtacgggtcccggtaaaccgggg

SEQ ID NO: 357769 - DNA, 743 bp, Homo sapiens
  misc_feature: GZ8MTXP01EPEK8.13.65.F10.1.454.CMB.2.raw
  modified_base (279)..(279): a, c, t, g, unknown or other
  misc_feature (279)..(279): n is a, c, g, or t
  modified_base (543)..(543): a, c, t, g, unknown or other
  misc_feature (543)..(543): n is a, c, g, or t
tcagtcacgtactacacgaccggtgctcgatttagctacgctctaagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccaggccgggggggtcctgagactctcctgtgcagcctctgggttcaccgtcagtcacacctanatgagcgtcgggtcccgccgacggccgtaccggaagggggaacggggcgtgggacgtcggtccgtttctttacgtttttaagtttagttaggttacggtttagggtaacgtactaacgttacccgtcccgacgtaacccggtacccgtccgggtagggaccgggggtaccctaaacttcccaaccctactccctaccgaagaacgaactaaacttacccaaagtaaccacgtctttacgtttaccttaactaaaatacgaaacncgacctagaacgacgccgagtcggaaccgaccggtacgttagttaacttcgtggtagacggtaggacggtacgggccggggaacccctaaacggttaaaccgtttaaccgacggtcgttaacggttcgggttaccggttcgggtaacgggggaacccgaacgggtaccccgaccggttacccgtaacccgttccgtcccg

SEQ ID NO: 357770 - DNA, 614 bp, Homo sapiens
  misc_feature: GZ8MTXP02GA3ZL.13.65.F10.1.454.CMB.2.raw
  modified_base (383)..(383): a, c, t, g, unknown or other
  misc_feature (383)..(383): n is a, c, g, or t
  modified_base (450)..(450): a, c, t, g, unknown or other
  misc_feature (450)..(450): n is a, c, g, or t
tcagtcacgtactacacgaccggtgctcgatttagctacgctctaagggggggagaggagcccagcactgggattccgaggtatttccattcggtgatcagcactgaacacagaggactcaccatggagttttggctgagctgggttttccttgttgctattttaaaggtgcccagtgtgaggtgcagctggtggagtctgggaggaggcttgatccagccgtgggggtccctgagactctcctgtgcagcctcgtgggttcaccgtcagtcacacctacatgagcgtcgggtccgccaggctccggaggggacggggctgggagtgtcgttctttcttttatttagtagtagtggtagtacactactccgcagacgtccggnggcgggggcctattccacctatctaccaagacgactaactaccaaagaaccacgtcttagtttctanaaatagaacagcctaggacgacgccgagtacgaccgacggtcgtgttacttacgtggtcgacgtaagaggtacggtcgggggacccctaacggtaaccgttacgtaccgataacggtcgggtacgttcggaccgggggaccaacgggggtaccctaacccgggg

SEQ ID NO: 357771 - DNA, 710 bp, Homo sapiens
  misc_feature: GZ8MTXP02HCBT6.13.65.F10.1.454.CMB.2.raw
tcagtcacgtactacacgaccggtgctcgatttagctacgctctaagggggggagaggagcccagcactgggattccgaggtatttccattcggtgatcagcactgaacacagaggactcaccatggagttttggctgagcttgggttttccttattactattttaaaaggtgtccagtgtgaggtgcagttggtggagtcgtgggaggaggtcgttggtccgagggccgggggggtccctgacgactctcctgtgcagcctcgtggttcaccgtcagtcacacctacagtgagcgtcgggtcccgccgaggccgtccggaaggggaggggcgtgggaggtcgtcgttctttacgttttatttagtaggttagtaggtaagtactataccgtccgacacgtaccgtccggtagggacggggtcctacgttccaccctactcctaccgaagaacgaaactaacttaacccgaaagtaaccaccggttacttgtttacccttaacgaaaagttacgaaacctacggtaccgtaaggacgaaccggcccgtaagtcggaacgtaacccgggtccggttagttacgttacgtggttacggaggtaacgaggtacggccggggtaacccaaacgggttaaccttacgaccgtagtacgtacgggtacgtcgggaacgggaccgaacgggacctccggtaccgtccgtacctcccg

SEQ ID NO: 357772 - DNA, 445 bp, Homo sapiens
  misc_feature: GZ8MTXP01DYTWR.41.36.D03.1.454.CMB.2.raw
  modified_base (331)..(331): a, c, t, g, unknown or other
  misc_feature (331)..(331): n is a, c, g, or t
  modified_base (439)..(445): a, c, t, g, unknown or other
  misc_feature (439)..(445): n is a, c, g, or t
tcagtctatactatcacgaccggtgctcgatttagctgcgtcacgatctctcttggggctggatccggcagccccagggagggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtcttcaatctatgggccgtggcaccctggtcactgtctcctcagcttccaccaagggcccatcggtctccccctggccnccctgctccaggacgcacctcgtcgggggcacgagccggccctggggctggcctggtcaaggctacttcctatatactgtctgagcgggctgggcaagggcgcatagnnnnnnn

SEQ ID NO: 357773 - DNA, 550 bp, Homo sapiens
  misc_feature: GZ8MTXP01CGNHF.41.36.D03.1.454.CMB.2.raw
  modified_base (267)..(267): a, c, t, g, unknown or other
  misc_feature (267)..(267): n is a, c, g, or t
  modified_base (486)..(486): a, c, t, g, unknown or other
  misc_feature (486)..(486): n is a, c, g, or t
tcagtctatactatcacgaccggtgctcgatttagctgcgtcacgatctctcttgggagctctcagagaggtgccttagccctggattccaaggcatttccacttggtgatcagcactgaacacagaggactcaccatggagttgggcctgcgctgggttttcctgttgctattttagaaggtgtccactgtgaggtgcggctggtggagtcgtgggggagcttggtacaggcgggggggtccctgagactctcctgtgcagcctcnggattcatcttcagtgacttatgcccatgaactgggtccgccaggcctccgagggggaaggggctgggagttggggtttcccattatgttaatagttgctggagatacccgacctactacgcagactcgtgtgaagggccgattcaaccaattcccgagggacaatcgaccaaggactcactgtatcgtaggaaatgaacagccgtagagaagaacggngacgacgggactgttcttcgttcttggttaccgaagtacgcgttccgggccgttaacgtttggg

SEQ ID NO: 357774 - DNA, 607 bp, Homo sapiens
  misc_feature: GZ8MTXP01AQ3ZN.41.36.D03.1.454.CMB.2.raw
  modified_base (395)..(395): a, c, t, g, unknown or other
  misc_feature (395)..(395): n is a, c, g, or t
  modified_base (475)..(475): a, c, t, g, unknown or other
  misc_feature (475)..(475): n is a, c, g, or t
  modified_base (487)..(487): a, c, t, g, unknown or other
  misc_feature (487)..(487): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagccgtgggagggtccctgagactctcctgtgtcgcctctggatcaccatcagtgaccactatagtggacgtggggtcccgccagggcctccgagggggaaggggctgggagtggcttgggccgacaaaggtaaaaaacaagttcgacccaagtcctttaancaagagacgtaccgcgtcgtcgtagagaaacgcaagtacttacccaccctacacgaagagatacgacttacgaagtactntatgtacttcgngacgtaatcgtaaacctaaaccgtaacggaaaaccggaaggaacgacggtacttagttagttattagtttgttagtttaagttagtttaacgtagtacgaacggtaacgttcggtaaccg

SEQ ID NO: 357775 - DNA, 578 bp, Homo sapiens
  misc_feature: GZ8MTXP01D2U25.41.36.D03.1.454.CMB.2.raw
  modified_base (221)..(221): a, c, t, g, unknown or other
  misc_feature (221)..(221): n is a, c, g, or t
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
  modified_base (425)..(425): a, c, t, g, unknown or other
  misc_feature (425)..(425): n is a, c, g, or t
  modified_base (446)..(446): a, c, t, g, unknown or other
  misc_feature (446)..(446): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttccttgttgttattttacaaggtgtcagagtgaagtgcagttggtggagtccggggganacttggtccagcctggagggtccctgagactctcctgtgtcgctctggatcaccatcagtgaccatatatggactgggtccgccaggctccgaggggaggggctggagtggcttgggccgacaagtaaaaaacaagttgacccaagctttaagcacagagtaccgccgcgtctagtagaaagccagnttcaccctntacaaganatgtacttacgaaggaacttntattagattcgtagacgtaaatcgtaaacctaaacgtaaggaaaaccgaaggaaccgacgggcttaagttagttaatttagtttggttaggtttgttacgtttaatacgtcgaaggtaaccttcggtaaccg

SEQ ID NO: 357776 - DNA, 667 bp, Homo sapiens
  misc_feature: GZ8MTXP01DIBHH.41.36.D03.1.454.CMB.2.raw
  modified_base (577)..(577): a, c, t, g, unknown or other
  misc_feature (577)..(577): n is a, c, g, or t
tcagtctatactatcacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagccccccagggaaggccctggagtggcttgcacacatcttctcgaatgaacgaaaatcctacagtacatctctagaagagcagtttaaccatctccaaggacacctaaccaaaggcaggtggtctttagatgaccaacatcggaccctgcggacaccaggacacatattaactgtgcagtagggtaatggacggggaaagaaacagtcttggtttctagttaattaataaacgttcttaaccagttcgtgggtaacggttcgttacggggggaacgtaaaacgggggaccctaaaccggggtccaacccggttcctcccgttacgaacgtccctttaccccgaaccgaaccggggcccctaacgttcccgggttacccctttccccccgngggtccccggtcccccttcggttccccttaccccggtaagggaccgtccccgtacccgttcgggttcggggggtcccaaaccggtccggg

SEQ ID NO: 357777 - DNA, 589 bp, Homo sapiens
  misc_feature: GZ8MTXP01E0F9H.41.36.D03.1.454.CMB.2.raw
  modified_base (392)..(392): a, c, t, g, unknown or other
  misc_feature (392)..(392): n is a, c, g, or t
  modified_base (446)..(446): a, c, t, g, unknown or other
  misc_feature (446)..(446): n is a, c, g, or t
  modified_base (492)..(492): a, c, t, g, unknown or other
  misc_feature (492)..(492): n is a, c, g, or t
  modified_base (522)..(522): a, c, t, g, unknown or other
  misc_feature (522)..(522): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtcagagtgaagtgcagttggtggagtccgggggagacttggtccagcctggagggtccctgagactctcctgtgtcgcctctggatcacatcagtgaccactatatggactggggtccgccgaggcctccggagggggaaggggctgggagtggcttgggcccgacaaaggtaaaaaacaaggttgaccctaaagtcctttaancaactaggacgtacgccgcgtctagtagaaagtccaagtactttccaccccttntaccgaaagtagatacgaactttacaaaggaacttcatttgattcngacgaatcgaactaaccgtagaaaaccggnggacgacgggattagtgttaattgttgttgtttgttgtttaatactacgaggtaacttggtaacccg

SEQ ID NO: 357778 - DNA, 685 bp, Homo sapiens
  misc_feature: GZ8MTXP01CPE0Y.41.36.D03.1.454.CMB.2.raw
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggaggtccgggggagtacgttggtccagccgtggagggtccctgagactctcctgtgtcgctctgatcacatcagtgaccactatagtggacgtgggtccgccgaggctccgagggggaagggcgtgggagtggcgttggccgacaaagtaaaaacaagttcgacctaagtactttaatacaacgaagtacgtaccgccgtcgtctagtagaaacgcccaagtaccttaccaaccccttctacgaaagagactacgtaacctttacaaagggtaaaccttcgtaagtttcgaactttcgtacgaccgtaaaagtacgtaaacccgtaaacccgtaaacgggaaaaaacccggaacgggaaaccgaaccgggggtacttaaggttaaacggttattttaagtttgggtttacgttttaaggttacggtttttaataacgttacgttaaacgggttaaccgttccgggttaaccccggg

SEQ ID NO: 357779 - DNA, 585 bp, Homo sapiens
  misc_feature: GZ8MTXP01D2R6I.41.36.D03.1.454.CMB.2.raw
  modified_base (327)..(327): a, c, t, g, unknown or other
  misc_feature (327)..(327): n is a, c, g, or t
  modified_base (562)..(562): a, c, t, g, unknown or other
  misc_feature (562)..(562): n is a, c, g, or t
  modified_base (579)..(579): a, c, t, g, unknown or other
  misc_feature (579)..(579): n is a, c, g, or t
tcagtctatactatcacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccagggaaggccctggagtggcttgcacacatcttctcgaatgaacgaaaaatcctacagtacatctctagaagagcagtttaaccatctaccaaggacacctaccaaaggcaggtgtctttagtatgaccaanatcggaccctgcggacacaggcacatattaactgtgctagtaggggtaatgggaacggggaaaagaaacagtcttggtttactgttaatttaattaagttcctttaccatcgtagggacgttcgtacgggggacgaaaacggggacccacgggtccacccgtcctcctcgacgtcctccaccgacggcccaagtccgttcctccccgttgcccgtcccttcgccttccgaaggcnccacgtcggcggggccncgccgg

SEQ ID NO: 357780 - DNA, 578 bp, Homo sapiens
  misc_feature: GZ8MTXP01BI85W.41.36.D03.1.454.CMB.2.raw
  modified_base (282)..(282): a, c, t, g, unknown or other
  misc_feature (282)..(282): n is a, c, g, or t
  modified_base (303)..(303): a, c, t, g, unknown or other
  misc_feature (303)..(303): n is a, c, g, or t
  modified_base (320)..(320): a, c, t, g, unknown or other
  misc_feature (320)..(320): n is a, c, g, or t
  modified_base (527)..(527): a, c, t, g, unknown or other
  misc_feature (527)..(527): n is a, c, g, or t
  modified_base (552)..(552): a, c, t, g, unknown or other
  misc_feature (552)..(552): n is a, c, g, or t
tcagtctatactatcacgaccggtgctcgatttagctgcgtcacgatctctcttgggagctctcagagaggtgccttagccctggattccaaggcatttccacttggtgatcagcactgaacacagaggactcaccatggagttggggctgcgtcttgggtttttccttgttgcttattttagaaggtgtccactgtgaggtgcggctgggtggagtcgtgggggagtcgttgggtacgagggccggggggggtccctggagctctccgtgtgcagcctcgnggattcatcttcagtgactancgcatgacgtcgggccncgaggcctacggagggggagggcgtagggtagttggtttaccattagttagttaatagttgctggagaactaacccactactacgcagtacctgtgacggacgggaccgtattaccaacctattccgaaggacaagtcgaccaaaggtacctacacgttagtactacgtaggaaatacgaactagcctagaggaagacggagaccgnggtctgttcgttcttcgttgtacgngacggtgttaccgggtccttggttcg

SEQ ID NO: 357781 - DNA, 710 bp, Homo sapiens
  misc_feature: GZ8MTXP01BD6BL.41.36.D03.1.454.CMB.2.raw
  modified_base (431)..(431): a, c, t, g, unknown or other
  misc_feature (431)..(431): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagtctgggttttccttgttgttattttacaaggtgtccagagtgaagtgcaggttggtgggaggtccgggggagacgttggccagccgtgggagggtccctgacgactctcctgtgtcgcctgtggatcaccatcagtcgaccactatagtggacgttcggggtccccgccgagggcctaccggagggggaacgggggtctgggggaggttcgggcgttcggggacccgtacaaaacggtaaaaaaactaaggtttcgacccgtaaagtccttttaancaacgaggacgtaccgccgtcgtctagtagaaacgcctaagtactttccaaccccttctacaaacggacgtatacggtaacctttaccgaaagggtaaaccttacgtaaatttacggtaattttcccgaggtaaccgtaaaacttacggtaaacccttaaaccgtaaacgggaaaaaccccgggaagggtaacccggaacggggtacttaagttaggttaatttagtttggttgtttgttacgtttaatacgtgttaacggtaaccgttcggtaacccg

SEQ ID NO: 357782 - DNA, 709 bp, Homo sapiens
  misc_feature: GZ8MTXP01EMHHU.41.36.D03.1.454.CMB.2.raw
  modified_base (235)..(235): a, c, t, g, unknown or other
  misc_feature (235)..(235): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
tcagtctatactatcacgaccggtgctcgatttagctgcgtcacgatctctcttgggagctctcagagaggtgccttagccctggattccaaggcatttccacttggtgatcagcactgaacacagaggactcaccatggagttggggctgcgcttgggttttccttgttgcttattttagaggtgtccatgtgaggtgcggctgggtggagtcgtgggggagtcgttggtacgngggcgggggggtccctgagctctctgtgcngctnggatcatctcagtgatatgccatgaacgtcgggtcccgcgaggcctacggagggggaagggtcgtagggtaggttggggtttaccaagtttagttagtttaaattagttgctggggaactaacttaacccaccttaaccgtacgacgtagtaccgttcgtagggtacgggaaaccggggtccctaacgtttacccgaaaccccgtaaagtttcccggaacggggaaacaaaggttaccgaaacccgtaaaagggtaacccttaccgtaaaccttagttaacgttaaccggttaaaggaaaacttacggaaacgtaaccgaccgttaaggaaacgggaacggaacggaaagggtaacccgaccgggtcttacggttacgttactttcgttaagggtacgtaaggtacggaccggtttccgggaacccgttaaggtttcggg

SEQ ID NO: 357783 - DNA, 626 bp, Homo sapiens
  misc_feature: GZ8MTXP01B4AEO.41.36.D03.1.454.CMB.2.raw
  modified_base (316)..(316): a, c, t, g, unknown or other
  misc_feature (316)..(316): n is a, c, g, or t
  modified_base (557)..(557): a, c, t, g, unknown or other
  misc_feature (557)..(557): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggagacgttggtccaggccgtggagggtccctgagactctcctgtgtcgcctcgtggactcaccatcagtcgaccactatatggactcgggtccnccgaggcctaccggaggggaggggtctgggagtcggcgttggccgtacaaaggtaaaaaactaaggttcgaccctaaagttactttaagacgaactagggacgtaccgccgtcgttactgtagaaacgccagtacttcccacccttctacgaagagtatacgtacttacgaaacgtacttacgtaatttcgactttcgaggaccgtaaatacgtaaaccttaaacccgaaggaaaacccgnggaaccgacggattgtagttatttgttgttgtttggtatttaactagtacgaggtaacttcggtaaccg

SEQ ID NO: 357784 - DNA, 637 bp, Homo sapiens
  misc_feature: GZ8MTXP01BFSU3.41.36.D03.1.454.CMB.2.raw
  modified_base (339)..(339): a, c, t, g, unknown or other
  misc_feature (339)..(339): n is a, c, g, or t
  modified_base (431)..(431): a, c, t, g, unknown or other
  misc_feature (431)..(431): n is a, c, g, or t
  modified_base (491)..(491): a, c, t, g, unknown or other
  misc_feature (491)..(491): n is a, c, g, or t
  modified_base (564)..(564): a, c, t, g, unknown or other
  misc_feature (564)..(564): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttattttacaaggtgtccagagtgaagtgcgagttgggtgggaggtccgggggagtacgttcggtccaggcccgtgggacgggtccctggacgtactccttcctggtcgtccgccttcgtggtactcaccatcagtcgaaccactatagtggactcggggtcccnccgaggcctaccggagggggtaacgggctagggagtcggcttcggggaccgaacgtaaaggtaaaaaacaggttcgacctaagttctttaancaacgtagacgtccgcgtcgtctagtagaaacgccagacttaccacccttatacaaaggngtactcgtaacttacgaaacgtactactattgattcgagacgtaaatcgtaacttaaaccgagaaaacccggngaccgaggacttgttagttattagtttgttagttgtttacgttaatagtcgttacggtaacgttgtaacccgg

SEQ ID NO: 357785 - DNA, 748 bp, Homo sapiens
  misc_feature: GZ8MTXP01DQI2O.41.36.D03.1.454.CMB.2.raw
  modified_base (280)..(280): a, c, t, g, unknown or other
  misc_feature (280)..(280): n is a, c, g, or t
  modified_base (427)..(427): a, c, t, g, unknown or other
  misc_feature (427)..(427): n is a, c, g, or t
tcagtctatactatcacgaccggtgctcgatttagctgcgtcacgatctctcttggggagctctgagagcggagccccagccccagaattcccaggttgttttcatttggtgatcagcactgaacacagaggactcaccatggagttcgggctgagcttgggttttccttgttgttattttacaaggtgtccagagtgaagtgcaggttggtgggaggtccgggggagtacgttggtccagccgtgggacgggtccctgagtactctcctgtgtcgcctntgactcaccattcagtcgacctactatagtggaccgtgggtccccgccgaggccgtccggagggggaagggggctgggaggttcggcgttcgggacccgaacgaaagtaaaaaaacgaagtttcggaccctaaagttaccttttaanaccgtaaacgaaggtaaccgtacccggccggtacgttcgtagtacggaaaacgtccaagtaacctttacccaaccccttaccgtacgaaagtacggataacggtacctttaacaaacggggtaacttcgtaatttcggaaactttccgtacgtaaccgtaaaacgttccgtaaaacccgttaaacccgtaaacggaaaaaaccccggggaacgaaaccgggaaaccgggtacttaaggttaaggttaattttagggtttgtttaggtttaagtttagtttaacttaagtcccgttaaagggtaaccttcggttaaccccgg

SEQ ID NO: 357786 - DNA, 632 bp, Homo sapiens
  misc_feature: GZ8MTXP01C2GUR.41.36.D03.1.454.CMB.2.raw
  modified_base (338)..(338): a, c, t, g, unknown or other
  misc_feature (338)..(338): n is a, c, g, or t
  modified_base (524)..(524): a, c, t, g, unknown or other
  misc_feature (524)..(524): n is a, c, g, or t
  modified_base (571)..(571): a, c, t, g, unknown or other
  misc_feature (571)..(571): n is a, c, g, or t
  modified_base (583)..(583): a, c, t, g, unknown or other
  misc_feature (583)..(583): n is a, c, g, or t
tcagtctatactatcacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccgagggaacggcccgtggagtggcttgcacacattccttctacgaatgaacgaaaatcctaacagtacatctctagaagagactaagtttaaccatctaccaaggacacctacaaaggcaggtgtactttagatacgaaccaanagtcggaccctaggacggacaccgacggacaataagttactaaacgttgcgacgtaaagggttaaagacggaacggggaaaagtaaacagtcgtttggtttactagttaattaagttaaacttcttaactatcgtaggacgttcgtaggggaacaaacgggggacccgtacggcaccggtcctccncgagtcccttaccgaaccgacggcccctagtccggtcccttccccgngccccgtccgcnccgttccgaggtccaccgtccgtcgggcggggaccaacggcgcccgggg

SEQ ID NO: 357787 - DNA, 609 bp, Homo sapiens
  misc_feature: GZ8MTXP01B31FT.41.36.D03.1.454.CMB.2.raw
  modified_base (415)..(415): a, c, t, g, unknown or other
  misc_feature (415)..(415): n is a, c, g, or t
  modified_base (434)..(434): a, c, t, g, unknown or other
  misc_feature (434)..(434): n is a, c, g, or t
  modified_base (453)..(453): a, c, t, g, unknown or other
  misc_feature (453)..(453): n is a, c, g, or t
  modified_base (463)..(463): a, c, t, g, unknown or other
  misc_feature (463)..(463): n is a, c, g, or t
  modified_base (503)..(503): a, c, t, g, unknown or other
  misc_feature (503)..(503): n is a, c, g, or t
  modified_base (580)..(580): a, c, t, g, unknown or other
  misc_feature (580)..(580): n is a, c, g, or t
  modified_base (587)..(587): a, c, t, g, unknown or other
  misc_feature (587)..(587): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggatacgttggtccaggcccgtggggacggggtcccctggacgtaccttctcccttggtcgtccgccttctggactccaccatcagtcgaccactatagtggactcgggtcccgccagggcctccgagggggaacgggcttgggagttggcttgggcccacaaggtaaaaacaggttcgacccaagtctttaanccaacagacgtaccgccgngtctgtagaaacgccagtnttccaccctntacaagagatcgacttacaaaggtactgattcgattccgngacgtaatcgtaacctaaccgtaggaaaaccggtggaaccacggggtcaagtcgttaattagttggttagttggttntttaacngtcgaggtaaccttgtaacccg

SEQ ID NO: 357788 - DNA, 717 bp, Homo sapiens
  misc_feature: GZ8MTXP01DLNAT.41.36.D03.1.454.CMB.2.raw
  modified_base (434)..(434): a, c, t, g, unknown or other
  misc_feature (434)..(434): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgttgttattttacaaggtgtccagagtgaagtgcgagttggtggaggtccgggggagacgttggtccagccgtggacggtccctgacgctctcctgtgtcgctcgtgatcaccatcagtcgaccactatagtcggacgtcgggtcccgcccgaagggcctacccggaagggggaagggggtcgtggggaggttcggtcgttcggggacccgaacgtaaaaggtaaaaaaacgtaaggtttccgacccgtaaacgttcttttaanacctaaacgtaggaacgttacccggcccggtcgtctaggtacgaaaacgtcccgaagtaaccttcccaacccgttctaacgaaacggaactagtacgaaccgtttaccgaaaacgggttaccttactaagttacgtatttcccgtaggtaaccgtaaagtacgtaaacccttaaaccgaacgaaaaaccccggaaggtaaacgacgggacttaagttagttagtttaagtttggtttagtttggttattttaatacgtcgttaagtaaccgttcggtaacccg

SEQ ID NO: 357789 - DNA, 692 bp, Homo sapiens
  misc_feature: GZ8MTXP01BHRSU.41.36.D03.1.454.CMB.2.raw
  modified_base (179)..(179): a, c, t, g, unknown or other
  misc_feature (179)..(179): n is a, c, g, or t
  modified_base (223)..(223): a, c, t, g, unknown or other
  misc_feature (223)..(223): n is a, c, g, or t
  modified_base (304)..(304): a, c, t, g, unknown or other
  misc_feature (304)..(304): n is a, c, g, or t
  modified_base (384)..(384): a, c, t, g, unknown or other
  misc_feature (384)..(384): n is a, c, g, or t
tcagtctatactatcacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcacgccaccctnagtctcaggtcggccccgaggggacgaccggcaggacttaccgngggtcggggcgacgcggttaggaaggtaaagtgtacaggtgaccagcagagcagccacgaccctgcgcgtgtcatctattngatcggccgggccgcctgagtcgacgtcctgccgtcgtccttccccgtccggctacccgtacgtccggtaacgggaaccncccgggaccccacccgtacgaaccccgtacgtacgacgggaccggtacgggggtaccgggacggggacccgggggtatacgggaacgggtacccgtaactttaacgttacgtacgtacgaacggtcgttacggggtacgggggaacgttaaggtaggtaacgttacgtaacgtaccgttaccggtacccgggttggttacgggtaccgggacgggacggaaccgagttcgtaccgttccgtaccgggtcgaccgttacggccgaacggtccgtcccgtccccgtcggttacctccgttcccgttcccg

SEQ ID NO: 357790 - DNA, 895 bp, Homo sapiens
  misc_feature: GZ8MTXP01CNSRA.41.36.D03.1.454.CMB.2.raw
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggttttccttgtttgttatttacaaggtgtcagagtgaagtgctaggttgggtggaggtccgggggagtacgttggtccaggccgtgggacgggtccctagagtactcttccgtgtcgtccgtcctgtggtactccacctatcaagtcgaccatagtgtaggacgttcgggcccgcgacgggtcctaccgggaagggggaacggggtcgtagggggacggttgggtccgtttcggggacccgtaaactaaaaacgggttaaaaaaaaccgtaaagggtttccgaaccccgttaaaggtaccctttttaagacccgaaacgtaaacgggaaccgggtttaaccccgccccgggttacgttcccgtagttaaaccggaaaaaccggccctaaacggttactttaccccaacccctttacgtaaacccgaaaaggtacggttaaattaccggtaaacctttaaacccgaaaaggggtaacccctttgttaaacggttttaggaacttttccgtaaaggaacccgtaaaacggtttaaccgaaaaccccgtttaaaaccggaaaaacccgggaaaaaacccggggtaacgtaaacccggggaaacccgggggtacttaaaacggttttagggttaaattttaaccgggttttggtttcgggtttttaaaggtttaaggtttttaaataacccgtagggttaaacgggttaaaacccttccgggggttaaaccccgggg

SEQ ID NO: 357791 - DNA, 838 bp, Homo sapiens
  misc_feature: GZ8MTXP01CXRCJ.41.36.D03.1.454.CMB.2.raw
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacaaggtgtccagagtgaagtgctaggttgggtgggaggtccgggggagtacgttgggtccaggcccgtgggacgggtccctggagtacctctccgttgtcgtccgtcctcgtggtatccacatcagtcgaccactatagtggacgtcgggtcccgccgaggcccgtaccggagggggtaacgggggccgtagggggtaggttcgggtaccgttcggggacccgtaaaccgaaaacggttaaaaaaaacgtaacggttttaccggacccgtaaacgttaccttttaacgtaccgaaaccggtaaacgggtaacgggttaacccggtccccgggtacgttacccgttaggttaacggaaaaccggtacccgtaaggtaacctttacccctaaccccgttaccttaacgtaaacggaacgtaacgtacggttaaacccttaaccgaaaacggggtaaaccctttacccgttaagtttacggtacctttccgtaacggaaccgttaaactacggtaaaaccccgttaaaacccgttaaaccggaaaaacccgggtaacggtaaaccgggacgggtacttaagtttagtttaatttaagtttcggttagttttggttaactttaagtacgttacggttaacgtaacgttccgtaacccggg

SEQ ID NO: 357792 - DNA, 702 bp, Homo sapiens
  misc_feature: GZ8MTXP01BJG29.41.36.D03.1.454.CMB.2.raw
  modified_base (285)..(285): a, c, t, g, unknown or other
  misc_feature (285)..(285): n is a, c, g, or t
  modified_base (318)..(318): a, c, t, g, unknown or other
  misc_feature (318)..(318): n is a, c, g, or t
  modified_base (598)..(598): a, c, t, g, unknown or other
  misc_feature (598)..(598): n is a, c, g, or t
  modified_base (668)..(668): a, c, t, g, unknown or other
  misc_feature (668)..(668): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggatacgttggtccatccgtgggacgggtccctgagtactctcctgtgtcgctgtggatcaccntcagtcgaccatatagtcggacttcgggtcccnccaaggcctaccggaggggggaagggcgtgggaggtcggcgttcggggcccgacaaacggtaaaaaactaaggttcgaccgtaagtcttttaagccaaagtagacggttaccgcggtactcgtgtagaaacgccaagtacttacccaacccgtctacgaaagtagactacggtaacctttacgaaaacggttaaccttcaaagtttttcggaaactttcccggaggtaacccgtaaagttccggaaacccctaaaaccggtacgggaaaaaaccccgggnggttaaaccccggcgggtaaacttaggttaggttaatttagttgggtttacgttaaggtttacgtttaanacgttcgaagggttaacccttcgggttaaccccg

SEQ ID NO: 357793 - DNA, 917 bp, Homo sapiens
  misc_feature: GZ8MTXP01CHANX.41.36.D03.1.454.CMB.2.raw
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgtttgttattttacaaggtgtccagagtgaagtgcgtaggttgggtgggacggtccgggggagtacgtttgggtccacggccgtggggtacgggtcccctaggacgtacttcctccgttggtcgtccgcccttcgtcggtacttcccgacctatcctaggttacgaaccctacttaattagtcgggtacgttcggggtcccgccgacgggtcctaccgggaagggggaacgggggtctgggggtaggttcgggtccgttcggggacccgtaacgtaaaacggtaaaaaacgtaaacggtttccgaccctaaaggttaccctttttaagacccgtaaacgaacggtacgtaacccggcccggtcggttacgttagggtaacggaaaaccgtcccgtaaaggttacctttaccccgtaacccccgtttactaaaccggaaaagggtcgtaaacgtttaccgggttaaaccctttaaaccgaaaacggggttaaaccctttcgttaaacgttttacggttaaaccttttccggaacggttaaccgttaaaacgtttaacccggtaaaaccccgtttaaaacccggtaaacgggtaaaaaacccccggggaaggggtaaaccccgggttaacggggtaaccttaaagggtttacggtttaattttttaacgggttggttttacggttttaaggtttagtttttaacgttacggtaacggaacgggtttaaccctttccggggtaaccccgg

SEQ ID NO: 357794 - DNA, 550 bp, Homo sapiens
  misc_feature: GZ8MTXP02HU9K9.41.36.D03.1.454.CMB.2.raw
  modified_base (233)..(233): a, c, t, g, unknown or other
  misc_feature (233)..(233): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
tcagtctatactatcacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtcgtgggggaggcttggtacgnggcgggggggtccctgagactctcctgtgcagcctctggattcatcttcagtgactatgccatgaacgtggtccgccaggcctccgaggggaagggctggagtgggttcattatgttaatnttgctggganactaccacctactacgcagactctgtagaacggccgtaattacaaccctaaattcccgaaggggtaacaagtacgacccaaaagaacttacaacttgtaatcgtagaaatgaacagacctagagagacgaggacacggctgtcttacttagtgttcgaaggtacgacgttccgggcttacgttcgg

SEQ ID NO: 357795 - DNA, 543 bp, Homo sapiens
  misc_feature: GZ8MTXP02IQYVN.41.36.D03.1.454.CMB.2.raw
tcagtctatactatcacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaatcctacagtacatctctgaagagcagtttaaccatctcaaggacacctccaaaggcaggtgtcttagtatgaccaacatggaccctgcggacaccaggcacatattactgtgcatgggtaatggacgggaaagaaacagctggtttctgtattataagtcttacatctgacgtctggggcaaagggaccacggtcacccgtctcctcacgcttccaccaacgggccctagtccggtccttccccgtcggccgcccctcgccttcccgaaggacgccgtaccgtcgtcgggggccacgaccgg

SEQ ID NO: 357796 - DNA, 532 bp, Homo sapiens
  misc_feature: GZ8MTXP02JR71N.41.36.D03.1.454.CMB.2.raw
  modified_base (308)..(308): a, c, t, g, unknown or other
  misc_feature (308)..(308): n is a, c, g, or t
  modified_base (371)..(371): a, c, t, g, unknown or other
  misc_feature (371)..(371): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (449)..(449): a, c, t, g, unknown or other
  misc_feature (449)..(449): n is a, c, g, or t
  modified_base (475)..(475): a, c, t, g, unknown or other
  misc_feature (475)..(475): n is a, c, g, or t
  modified_base (510)..(510): a, c, t, g, unknown or other
  misc_feature (510)..(510): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccncaggctccgagggaggggctggagtggcttggccgacaagtaaaacaagttcgccagctttancacagagtacgccgcgtctgtagaaacgccagacttcaccctntacaaagngatgaacttcaaagactcattgattcngacgaatgaacctactagaaaaccgnggacaggcagttgtaatgttgtagttgtcgtttanattacgacggtaactgtacccg

SEQ ID NO: 357797 - DNA, 569 bp, Homo sapiens
  misc_feature: GZ8MTXP02IXCWX.41.36.D03.1.454.CMB.2.raw
  modified_base (223)..(223): a, c, t, g, unknown or other
  misc_feature (223)..(223): n is a, c, g, or t
  modified_base (379)..(379): a, c, t, g, unknown or other
  misc_feature (379)..(379): n is a, c, g, or t
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttccttgttgttattttacaaggtgtccagagtgaagtgcagttggtggaggtccggggganacttggtccagcctgggagggtccctgagactctcctgtgtcgcctctggattcaccatcagtgaccactatatggactgggtccgccaggctccgaggggaagggctgggagtggcttgggccgaccaagtaaaaacaagttgacctagctttanacaagagacgtaccgcgtcgtcagtagaaacncagtactccaccctnacaaganatagaactacaagactntattgtatcgagacgtaatactaacctaaacgacgaaaaccgaggaccgacggactagttagttacttagttgttagtttaagtttattaacgtagtacgtaacgtacgttacgtaccg

SEQ ID NO: 357798 - DNA, 567 bp, Homo sapiens
  misc_feature: GZ8MTXP02ICQ8O.41.36.D03.1.454.CMB.2.raw
  modified_base (309)..(309): a, c, t, g, unknown or other
  misc_feature (309)..(309): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (393)..(393): a, c, t, g, unknown or other
  misc_feature (393)..(393): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
  modified_base (443)..(443): a, c, t, g, unknown or other
  misc_feature (443)..(443): n is a, c, g, or t
tcagtctatactatcacgaccggtgctcgatttagctgcgtcacgatctctcttggggagctctgagagcggagcccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagcctgggagggtccctgagactctcctgtgtcgcctctggattcaccatcagtgaccatatatggactgggtccnccaggctccgaggggaggggctggagtggcttggccgcaaagtaaaaacaagttcgccaagtctttancanagacgtaccgcgntctgagaacgcagtactccacctnacaaganatcgtacttacaaagactntattgtattcgagacgtaatacgaacctaaaccgtaacggaaaaccgaggaccgacgggactaagttagttattacgtttgttgtttgttactttaatactacgtaacggtacttcggtacccg

SEQ ID NO: 357799 - DNA, 610 bp, Homo sapiens
  misc_feature: GZ8MTXP02ILE5N.41.36.D03.1.454.CMB.2.raw
  modified_base (376)..(376): a, c, t, g, unknown or other
  misc_feature (376)..(376): n is a, c, g, or t
  modified_base (519)..(519): a, c, t, g, unknown or other
  misc_feature (519)..(519): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttctgttgttatttacaaggtgtcagagtgaagtgcagttggtggagtccgggggagacttggtccagcctgggacgggtccctgagactctcctgtgtcgcctctggattcaccatcagtcgaccactatatggactgggtcccgccaggctccgaggggaggggctgggagtggcttggccacgaaagtaaaaacagttcgacctagtctttncacagagtaccgcgacgtctagtagaaacgccaagtacttcccaccctctacgaaagagatagacctttacgaaagtaactactatttgaattcgtacgacggtaaattacggaaaccttaaaccgtaacggaaaaacccggngggaaaccgacggggactaaagttacggttaactttagtttgttggtttaagttagttttaatacgtacgaaggtaacttcggtaacccgg

SEQ ID NO: 357800 - DNA, 687 bp, Homo sapiens
  misc_feature: GZ8MTXP02FNA0L.41.36.D03.1.454.CMB.2.raw
tcagtctatactatcacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagccccccagggaaggccctggagtggcttgcacacatcttctcgaatgaacgaaaatcctacagtacatctctgaagagcagtttaaccatctccaagacacctacaaaagcaggtgtctttagtatgaccaacatcggacccctggccggacaccgaggcacatattactgtgacacggggtaaatcggacggggtaaaagaaaccgagtcttaggtttctagttaatttaattaaagttaccttaaccctagttaccgttagggtaccgttcggtagggggtaccgaaaacgggggtaccctaaccggggttaccgtaaccccggtccttaccccgtaccgtacggtacctttacccccgaacccgtaaaccggggccccctaacgttcccggggttcccctttccccccggtcgggtcccgtcccccgttcgcccgttcccgacgggaaccgtcccgacccgttccggtcgggggacccgaccggacggtccccggg

SEQ ID NO: 357801 - DNA, 612 bp, Homo sapiens
  misc_feature: GZ8MTXP02I0JPY.41.36.D03.1.454.CMB.2.raw
  modified_base (380)..(380): a, c, t, g, unknown or other
  misc_feature (380)..(380): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggagacttggtccagcctggaggtccctgagactctcctgtgtcgcctctggattcaccatcagtgaccactatatggactgggtcccgccaggctccgaggggaagggctgggagtggcgttggccgacaaagtaaaaacagttcgccagtcctttancaacaggacgtaccgccgcgttctgtagaaacgccaagtacttccaccctctacaagagatgaccttagaaacgactactagttgtaacttcgtagacgtaatacgaacctaaaccgtaacgaaaaacccggacggaaaccgacggggactaagttacgttaagtttaacgtttggttagttttcggttagtttttaaagtactacgtaaaggtaacctttgttaaccccgg

SEQ ID NO: 357802 - DNA, 596 bp, Homo sapiens
  misc_feature: GZ8MTXP02IZJA9.41.36.D03.1.454.CMB.2.raw
  modified_base (380)..(380): a, c, t, g, unknown or other
  misc_feature (380)..(380): n is a, c, g, or t
  modified_base (397)..(397): a, c, t, g, unknown or other
  misc_feature (397)..(397): n is a, c, g, or t
  modified_base (410)..(410): a, c, t, g, unknown or other
  misc_feature (410)..(410): n is a, c, g, or t
  modified_base (428)..(428): a, c, t, g, unknown or other
  misc_feature (428)..(428): n is a, c, g, or t
  modified_base (455)..(455): a, c, t, g, unknown or other
  misc_feature (455)..(455): n is a, c, g, or t
  modified_base (470)..(470): a, c, t, g, unknown or other
  misc_feature (470)..(470): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagccgtgggagggtccctgacgactctcctggtgtcgcctctggacttcaccatcagtgaccactatatggactggtccgccaggctcgaggggagggctggagtggcgtggccgacgaaagtaaaaacagttcgccagtctttancaagagacgtacgccgngtctagtagaaanccgaagacttccaccctntacaagagatgacttagaaagtacctnagtttgactttacgngacgtaagtacgaaccttaaaccgacgaaaaacccggacggaaccgacggggactaagtacgttagtttaagttggttacgtttaagttacgtttaatacgtacgaacggttactacggttacccg

SEQ ID NO: 357803 - DNA, 641 bp, Homo sapiens
  misc_feature: GZ8MTXP02GZF2X.41.36.D03.1.454.CMB.2.raw
  modified_base (410)..(410): a, c, t, g, unknown or other
  misc_feature (410)..(410): n is a, c, g, or t
  modified_base (470)..(470): a, c, t, g, unknown or other
  misc_feature (470)..(470): n is a, c, g, or t
  modified_base (561)..(561): a, c, t, g, unknown or other
  misc_feature (561)..(561): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagccgtggacgggtccctgagactctcctgtgtcgctctggattcaccatcagtgaccactatatggactcggggtcccgccgaggcctaccggaaggggaacgggggctggggaggttggggcttcggggaccgaccgaaaaggttaaaaaaccaaagtttcgacctagtctttancaacgaggacgtaccgccgcggtctaggtagaaaacgcccaaagtactttcccacccctntaacaaagagattcgaaaccttacgaaagtaactctaaatttggaacttcgtagacgtaaattcgaaaccttaaaccgtagaaaaacccgnggacgaccggactagtagttaattagttggttagtttaagttcgtttaatacttacgtaaacggtacttcggttaacccg

SEQ ID NO: 357804 - DNA, 607 bp, Homo sapiens
  misc_feature: GZ8MTXP02H6ZAR.41.36.D03.1.454.CMB.2.raw
  modified_base (209)..(209): a, c, t, g, unknown or other
  misc_feature (209)..(209): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (324)..(324): a, c, t, g, unknown or other
  misc_feature (324)..(324): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggnggaggtccgggggatacttggtccagccgtggaggtccctgagactctctgtgtcgctngatcacntcagtgacattanatggactggccncgaggctcggaggggagggctggngtggctggccacaaagtaaaaccagttcactagtctttagcaacagacgtaccgcgacgtctgtagaaagcccaagtaccttccaaccccttctaacgaaagtagtactgtaaaccttacgaaaagtaacttcaaagttgtaactttcgtagacgtaaatacgaacctaaaccgtaacggaaaaacccggtggaaccgaacgggtactaagttagtttaattacgtttgttaggtttaacgttagttttaaatacgtacgtaacggttacttacggtacccgg

SEQ ID NO: 357805 - DNA, 649 bp, Homo sapiens
  misc_feature: GZ8MTXP02IKB3O.41.36.D03.1.454.CMB.2.raw
  modified_base (187)..(187): a, c, t, g, unknown or other
  misc_feature (187)..(187): n is a, c, g, or t
  modified_base (209)..(209): a, c, t, g, unknown or other
  misc_feature (209)..(209): n is a, c, g, or t
  modified_base (224)..(224): a, c, t, g, unknown or other
  misc_feature (224)..(224): n is a, c, g, or t
  modified_base (396)..(396): a, c, t, g, unknown or other
  misc_feature (396)..(396): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtntccagagtgaagtgcagttggnggaggtccggggganacttggtccatccgtggacggtccctgagactctcctgtgtcgcctgtggacttcaccatccagtcgaccatatagtcggacgtgggtcccgccaggcctaccggaggggaaggggctgggacgtggcgttggcccgagaaagtaaaaaccagttcgaccctagtcctttanacgaacgacggacgtaccgcgtcgtcgtagtacgaaacgcctacgtaccttacccaccctcttaacgaagtacgtacgtacgtaactacgaaacgtaccttatacgttagtaacttcgtagacgtaagtaacgtaaccgtaaaccgtaaacgaaaaccgaacggaccgacgggtactagaaacgtttacgttacgtttagttagttaagtttaagtttaaccgttacgtaaccgtaacgtacgttaccgtacg

SEQ ID NO: 357806 - DNA, 645 bp, Homo sapiens
  misc_feature: GZ8MTXP02IEWFR.41.36.D03.1.454.CMB.2.raw
  modified_base (272)..(272): a, c, t, g, unknown or other
  misc_feature (272)..(272): n is a, c, g, or t
  modified_base (406)..(406): a, c, t, g, unknown or other
  misc_feature (406)..(406): n is a, c, g, or t
  modified_base (468)..(468): a, c, t, g, unknown or other
  misc_feature (468)..(468): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagccgtggagggtccctgagactctcctgtgtcgcctntggattcaccatcagtcgaccactatagtggacgtcgggtcccgccgaggcctaccggaaggggaaggggcgtgggaggtgggcgttcgggaccgaccgaaaagtaaaaaacaaagttcgacctaagtctttanaccaaacgaagacgtaccgccgtcgtctagtaagaaaacgtccaaagtacttcccacccctnaacaaagacgatacgaacttacaaaagtacttcaatttgatttcgagactaaatcgtaaacctaaccgtaacggaaaaacccggacggaaaccgacgggactaaagttaggttaactttagtttgttgtttaagtttagtttaatacgtacgtaaggtaaccctttcggtaacccgg

SEQ ID NO: 357807 - DNA, 831 bp, Homo sapiens
  misc_feature: GZ8MTXP02GOS1I.41.36.D03.1.454.CMB.2.raw
  modified_base (188)..(188): a, c, t, g, unknown or other
  misc_feature (188)..(188): n is a, c, g, or t
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagtctgggttttccttgttgttattttacaaggtntcagagtgaagtgcaggttggtggaggtccgggggatacgttggtccagccgtgggacgggtccctgacgtactctcctgtgtcgcctntggattcaccntcagtcgaccactatagtggacgtcgggtcccgccaggccgtaccggagggggaacggggtcgtggggtacggttcgggccgtttcggggacccgaccgtaaaacggtaaaaaaacctaaagggtttcgaacccctaaggttcttttagaccaacgaagggacgtaacccggccgacgttcgtagtacggtaaaacgcccgtaaaggtacctttaccccaaccccctttcgtaaccgaaaaggtagggaacttacggtaaacctttaaccgaaaacggtaaactttacctaaacgtttaggtaactttacccgtaggtaaccggtaaaagttaccgggtaaaaccctttaaaaccccggtaaaacgggaaaaaaaacccccggggtagggtaaaaccccggggaaccgggggtaaaccttaaacgggttacgggtttttaaactttaaacggtttttgggtttacgggtttttaaggtttaaggtttttaacttaacggtaaccggttaaaacggggtaaaccgtttcgggtttaaaccccgg

SEQ ID NO: 357808 - DNA, 591 bp, Homo sapiens
  misc_feature: GZ8MTXP02JYI3L.41.36.D03.1.454.CMB.2.raw
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgacccactatatggactgggtccncaggctccgaggggaggggctgggagtggcttggccgcgagtaaaaacaagttgaccagctttncacagagtacgccgngtcngtgaaagccagattcccgaccctctacaagacgatacgacttacgaaagacctagaattggtaatttcctgaccgaagttcgaaaccttaaaccctaggaaaaaccccgagggaaccaacggggcctagttagtaacgtttattagttggtttgttagttttaacgtagttaccgagggttaaacctgggtaacccccg

SEQ ID NO: 357809 - DNA, 654 bp, Homo sapiens
  misc_feature: GZ8MTXP02JP14I.41.36.D03.1.454.CMB.2.raw
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgttgttatttacaaggtgtccagagtgaagtgcaggttggtggaggtccgggggagtacgttggtccagccgtgggacgggtccctgagactctcctgtgtcgcctctgattcacatcagtcgaccactatagtggacgtgggtccgccgaggcgtccggaggggaggggctgggagtggcttcggccgacgaaagtaaaacgaagttacgaccgagttctttatccaacgaggtacgtaccggcccgtacgtcgtagtacgaaaacgccaagtacttacccaccctctacgaaagacgtatacgtaaacttacgaaagtaactctaagtttacgtacttcgtacgaacgtaaagtctaaaccgttaaaccgaaacggaaaaacccggacggaccgacggggtactagtttagttacgtttaagtttggtttacgtttaaggttacttttaagtacgtacgtaacggtaccttacggtacccgg

SEQ ID NO: 357810 - DNA, 736 bp, Homo sapiens
  misc_feature: GZ8MTXP02JBCE0.41.36.D03.1.454.CMB.2.raw
  modified_base (428)..(428): a, c, t, g, unknown or other
  misc_feature (428)..(428): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttattttacaaggtgtccagagtgaagtgctaggttgggtgggaggtccgggggatacgttggtccaggccgtgggacgggtccctgacgactctcctgtgtcgcctctgatcaccatcagtcacctactatagtggacgtcgggtcccgccgaggcctccggaagggggaaggggtccgtggggaggtggggtcgttcgggaccgtaacgaaaacggttaaaaaacaaacggtttcgacctaagttcctttanacgaacgaggtaccgtaccgcccggtacgtcgtaggtaacgaaactccgtagtacttacccacccctctaacgaaagtgacttacgtaaaccttaacgaaaacgtaactttactaacgtttggtaaactttcccgaaggtaccgtaaaacttacgggtaaacccttaaaacccgtaaaagggaaaacccccgggaagggaacccgtaacgggggtactaaacgtttggtttaaaattttacgtttggtttagtttaagtttgttttaaacgtacgttacggaacgggttaaccctttgggtaaacccg

SEQ ID NO: 357811 - DNA, 726 bp, Homo sapiens
  misc_feature: GZ8MTXP02GOPXT.41.36.D03.1.454.CMB.2.raw
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (431)..(431): a, c, t, g, unknown or other
  misc_feature (431)..(431): n is a, c, g, or t
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttgggtggaggtccgggggagtacttggtccagcctgggacggtccctgagactctctgtgtcgcctntggnttcaccatcagtgaccctatatagtggacgtcggggtcccgccgaggccgtaccggaaggggggaacggggtctagggggaggtcgggtccgtttggggaccccgaccgtaaaaggtaaaaaaccaaggtttcgaccctaaggtacttttacnccgaacgtaaacggacgtaacccggcccgtgttccgttaggtaaggaaaacggcccctaaggtactttaccccacccttcctacaaaatggaaacttcgaaaccgtttacaaaacggtaacccttatagtttacgtatttccgtacggacggtaaattcggtaaaccctaaaaccgtacggaaaaaccggacggggacccaaggggacttaagttggttaactttaacggtttgtttacgtttaagggtttacttttaagttaccgtggtaaacggtaactttaccggtacccgg

SEQ ID NO: 357812 - DNA, 829 bp, Homo sapiens
  misc_feature: GZ8MTXP02HV6FS.41.36.D03.1.454.CMB.2.raw
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctaggttggtgggaggtccgggggagtacgttgggtccaggtcccgtgggacgggtccctggacgaccttctcccgtgtcgtccgccttgtggtacttccaccatcgagtcgaaccctactagtagtcggaccgtcgggtcccgcgaggtcctaccgggaagggggaggggcgtggggagtcgggtcgttgggacccgagtaaaacgttaaaaaacgaaggttcgaacctagttacttttacgaccgaaacgacgtacggtaccgcccggtccgttcgtaggtacgaaaacggtcccaagtacttaccctaacccctgtaaccgaaaggacgtacgttacggtaaacctttacggtaaaacgtaacctttactaaagttttcgggtaacctttacgttacggggaaacccttaaaaagttaccggtaaaaccccctttaaaaccgggtaaaacgggggaaaaaaccccccgggtagggggaaaaccccgtaaccgggggtaaccctttaaacgggtttaacttttaaacgggtttttaaacgtttccgggtttaggttttcggtttaaagttttaacgtttacggtaccgttaaaagggttaacccgtttttcggtaaaccccgggg

SEQ ID NO: 357813 - DNA, 589 bp, Homo sapiens
  misc_feature: GZ8MTXP01AV2ZU.15.70.G04.1.454.CMB.2.raw
  modified_base (583)..(589): a, c, t, g, unknown or other
  misc_feature (583)..(589): n is a, c, g, or t
tcagtctacgtagccacgaccggtgctcgatttagtgtagtgtgaagggaaaggggaagaccgatgggcccttggtgaagccttcggagaccctgtccctcacctgcactgtctctggtgactccatcagtccttactactggacctggatccggcagcccccagggaagggactggagtggattggatatatctattacagtggggcaccaactacaacccctcctcaagagtcgagtcatcatttcagtagacacgtccaagaaccagttctccctgaagatgagctctgtgaccgccgctgacacggccgtctattattgtgcgagacatcggcactagttgtcgacccgtgggccaggggacccggtcaccgtcgcctcacgccctcccaccgaagggccccagtcccggtcccttccccgtcggcccacccctccctacccaaacgcgccacccgtcgtcgggggccacgacggccggggcccgtggggcctcggcccgtggtccaacggaccttaccgttcccgacttaccgtaggaactggacggccgggcgtcgggcgaacgggcgacgaatagnnnnnnn

SEQ ID NO: 357814 - DNA, 659 bp, Homo sapiens
  misc_feature: GZ8MTXP01DYI73.15.70.G04.1.454.CMB.2.raw
  modified_base (273)..(273): a, c, t, g, unknown or other
  misc_feature (273)..(273): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
  modified_base (654)..(655): a, c, t, g, unknown or other
  misc_feature (654)..(655): n is a, c, g, or t
  modified_base (657)..(657): a, c, t, g, unknown or other
  misc_feature (657)..(657): n is a, c, g, or t
  modified_base (659)..(659): a, c, t, g, unknown or other
  misc_feature (659)..(659): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcagccccagggaaggactggagtggattggatatatctattacagtggggcaccaactacaacccctcctcaagagtcgagtcatcatttcagtagacacgtcaaagaaccagttcncctgaagatgagctctgtcgaccgccgctgacacggtccgtactattattgtgcgagacagtcggctaccttaagttcggtccgaccccgtggggaccacggggaacccggtcacccgtcgcctcgacgccctacccgaccgaacgggcccctatttccggtcccttcccccgtggaccctacccctcctaccaaacgacgaccaccctcgtcgggtcggacacgacggggcccggtcccgttcggggccttcggccccgtgggtaccgtaaacgggtacctttacccgttacccgtaccgttaaccgggtaacgtaaccgttgggaacgggccggggcgttcggggaaccgaacgggcccggaacttaaaggtcgngngnngngn

SEQ ID NO: 357815 - DNA, 590 bp, Homo sapiens
  misc_feature: GZ8MTXP01BFVY3.15.70.G04.1.454.CMB.2.raw
  modified_base (584)..(590): a, c, t, g, unknown or other
  misc_feature (584)..(590): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcagcccccagggaagggactggagtggattggatatatctattacagtggggcaccaactacaacccctcctcaagagtcgagtcatcatttcagtagacacgtccaaagaaccagttctccctgaagatgagctctgtcgacccgccgctgacacggccgtctatttatgtgcgagacatcggcacctaagttggtcgaccccgtggggccaggggacccggtcacccgtcgcctcacgccctccaccgaacgggccccagttcccggtccttccccgtcggcccacccctccctacccaacgacgccacccgtcgtcgggggccacgacggccgggggcccgtcggggcctcggccgtggtcgaacggacctaccgttccgctaccgtagaacgtggaggcgggcgtcggcgaacggcgcaagagnnnnnnn

SEQ ID NO: 357816 - DNA, 593 bp, Homo sapiens
  misc_feature: GZ8MTXP01BEAXK.15.70.G04.1.454.CMB.2.raw
  modified_base (584)..(584): a, c, t, g, unknown or other
  misc_feature (584)..(584): n is a, c, g, or t
  modified_base (586)..(589): a, c, t, g, unknown or other
  misc_feature (586)..(589): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
tcagtctacgtagccacgaccggtgctcgatttagtgtagtgtgaagggaaaggggaagaccgatgggcccttggtgaagccttcggagaccctgtccctcacctgcactgtctctggtgactccatcagtccttactactggacctggatccggcagcccccagggaagggactggagtggattggatatatctattacagtggggcaccaactacaacccctcctcaagagtcgagtcatcatttcagtagacacgtccaagaccagttctcctgaagatgagctctgtgaccgcgctgacacggccgtctattattgtgcgagacagtcggcaaccgttaagttcggtccgaccccgtggggccacggggaacccggtcacccgtcgccctcacgccctccaccgaacgggcccatccgtccttcccctcggccacccctcctaccaacgacgcacctcgtcggggcacgacgccggggcccgtcgggctcggccgtcggtacgaacggtacctaccgtccgtaccgtacgtacggaaccgttggacggcggggcgtgggacgaacgggcgcgaagtaggngnnnngngn

SEQ ID NO: 357817 - DNA, 691 bp, Homo sapiens
  misc_feature: GZ8MTXP01CSSMO.15.70.G04.1.454.CMB.2.raw
  modified_base (319)..(319): a, c, t, g, unknown or other
  misc_feature (319)..(319): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
  modified_base (690)..(690): a, c, t, g, unknown or other
  misc_feature (690)..(690): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcagcccccagggaagggactggagtggattggatatatctattacagtggggcaccaactacaacccctccctcaagagtcgagtcatcatttcagtagacacgtccaagaaccagttcctccctgaagatgagctctgtgacccgccgctgacacggccgtntattattgtgcgagacagtcggacaccgttaaggttcggttccgacccccgttcgggggaccctacgggggaaccccggtcaacccggtccggccctcgacgggccctcccgaaccgaacggggccccctaagttcccggtccctttacccccgtcgggtaccctaccccttcccttacccgaaacgaccgcctaaccccgtcgttcgggggaccacgacggcccggggcccgttcggggccgtcgcccgttggtacccgaaacgggtaccctaccgttcccgtacgttaaccggtacgaaaccgttcggaacgggtccggggacgtacggggaccgaaacgggccgacgaacgtacggcgngngcngngng

SEQ ID NO: 357818 - DNA, 626 bp, Homo sapiens
  misc_feature: GZ8MTXP01BMSCI.15.70.G04.1.454.CMB.2.raw
  modified_base (582)..(582): a, c, t, g, unknown or other
  misc_feature (582)..(582): n is a, c, g, or t
  modified_base (620)..(626): a, c, t, g, unknown or other
  misc_feature (620)..(626): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcacgcccccgagggaagggactggagtggattggatatatctattacagtggggcaccaactaccaacccctcctcaagagtcgagtcatcatttcagtagacacgtccaagaaccagttctccctgaagatgagctctgtcgacccgccgctgaccacggccgtctatttattgtcgcgagacagtcggacctacgttaaggttcggttccgaccccggtcggggaccgacggggaacccggtcgacccgtcgccctcgacgccctacccaacccgaacggggcccctacgtccggtcccctttcccccgaggccctacccctccctaccgaaacgcgccaacccgtcggcggggcaacgcggtcccggggcccgttggggcctcggaccgttcggacgaacggtacctcgttccgacgtacggngaactggcggccgggggcgtggacgacggcacgaatgnnnnnnn

SEQ ID NO: 357819 - DNA, 632 bp, Homo sapiens
  misc_feature: GZ8MTXP01BSNDJ.15.70.G04.1.454.CMB.2.raw
  modified_base (626)..(632): a, c, t, g, unknown or other
  misc_feature (626)..(632): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcagcccccagggaagggactggagtggattggatatatctattacagtggggcaccaactacaacccctcctcaagagtcgagtcatcatttcagtagacacgtaccaaagaaccagttctccctgaacgatgagctctgtcgaccgccgctcgacacggccgtctattattgtgacgagacactcggacaccgttaagttcggttaccgaccccggtgggggcccaacggggaccccgggtcacccggtccgccctcacgcccctaccgaaccgaacggggccccagtcccggtcccttcccccgtcggccacccctccctaccgaacgacgccacccgtcggtcgggggacacgaccggccgggggcccgtcggggctcggccgtcgggtaccaacgggtacccttccgttcccgacgtaccgtaagaacgtgacggtcggggcgtagggcgaagggccgacaagtgnnnnnnn

SEQ ID NO: 357820 - DNA, 632 bp, Homo sapiens
  misc_feature: GZ8MTXP01B3T4T.15.70.G04.1.454.CMB.2.raw
  modified_base (626)..(632): a, c, t, g, unknown or other
  misc_feature (626)..(632): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcacgcccccagggaagggactggagtggattggatatatctattacagtggggcaccaactacaacccctcctcaagagtcgagtcatctatttcagtagacacgtccaaagaaccagttctcctagaagatgagctctgtcgaccgccgctgacacggtccgtctattatgtgcgagacagtccggactaccgttaaggttcggttccgaccccgtcgggggcccgacgggggtaccccggtcacccggtccgcccgtcacgccctccacccgaacgggcccctagtcccggttcccttcccccgtcggaccctacccctccctacccgaaacgcgcctaacccgtcgtcggggaacacgacggtccggggcccggttcggggcctcggcccgttggactaacgggtaccttacgtcccggtactacgtagaacctggacggcgggcgtcggacgacgggcacgtgacnnnnnnn

SEQ ID NO: 357821 - DNA, 642 bp, Homo sapiens
  misc_feature: GZ8MTXP01EFKBE.15.70.G04.1.454.CMB.2.raw
  modified_base (613)..(613): a, c, t, g, unknown or other
  misc_feature (613)..(613): n is a, c, g, or t
  modified_base (618)..(618): a, c, t, g, unknown or other
  misc_feature (618)..(618): n is a, c, g, or t
  modified_base (635)..(642): a, c, t, g, unknown or other
  misc_feature (635)..(642): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcacgcccccagggaaggactggagtggattggatatatctattacagtggggcaaccaactaccaaccccctcctacaagagtcgagtcatcatttcagtagacacgtcaaagaaccagttcctccctagaagatgagctctacgtcgacccgccgctcgaaccgaccggccgttctatttattgtgacgagacagtccgactaccttaagttcggtacccgaccccggtccggggccgaacggggaccccgggtcacccggtccgccctcgacgtccctacccaaccgaacgggcccctacgttcccgggtcccttcccccaggcccacccccttccaccgaaacggccacctaacccgtcggacggggaccaacgcgggcccggggtccgtggggcctcgacgtcggaccgagtaccttcgtcccgacgttacgagtcgacggcgggcggttcgnggganaaacgggttccagaagnnnnnnnn

SEQ ID NO: 357822 - DNA, 565 bp, Homo sapiens
  misc_feature: GZ8MTXP02JW0KZ.15.70.G04.1.454.CMB.2.raw
  modified_base (291)..(291): a, c, t, g, unknown or other
  misc_feature (291)..(291): n is a, c, g, or t
  modified_base (316)..(316): a, c, t, g, unknown or other
  misc_feature (316)..(316): n is a, c, g, or t
  modified_base (372)..(372): a, c, t, g, unknown or other
  misc_feature (372)..(372): n is a, c, g, or t
  modified_base (420)..(420): a, c, t, g, unknown or other
  misc_feature (420)..(420): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (564)..(565): a, c, t, g, unknown or other
  misc_feature (564)..(565): n is a, c, g, or t
tcagtctacgtagccacgaccggtgctcgatttagtgtagtgtgaagggaaagggggaagaccgagtgggcccttggtgaagccttcggagaccctgtccctcacctgcactgtctctggtgactccatcagtccttactactggacctggatccggcagccccagggaagggactggagtggattggatatatctattacagtggggcaccaactacaaccctcctcaagagtcgagtcatcatttcagtagacacgtccaagaaccagttctccctgaagatgagctcngtgaccgccgctgaccacggccgtntattatgtgcgagacatcggcactaagtgtcgaccctggggccaggggacccggtnaccgtcgctcagctccaccacgccactcgtctccctcgcaccctcccncacgacgcactcgtcgggcgacgacgccggccgtcggtcgtcgtccgtcggtacgaacggtaaccgtaccgttaccgtaccgtacgtaacgtacgtacggaggcgggcggtcggacgacggacgacgaacgacgcgcncncncnn

SEQ ID NO: 357823 - DNA, 539 bp, Homo sapiens
  misc_feature: GZ8MTXP02JMASC.15.70.G04.1.454.CMB.2.raw
  modified_base (450)..(450): a, c, t, g, unknown or other
  misc_feature (450)..(450): n is a, c, g, or t
  modified_base (459)..(459): a, c, t, g, unknown or other
  misc_feature (459)..(459): n is a, c, g, or t
  modified_base (531)..(531): a, c, t, g, unknown or other
  misc_feature (531)..(531): n is a, c, g, or t
  modified_base (533)..(539): a, c, t, g, unknown or other
  misc_feature (533)..(539): n is a, c, g, or t
tcagtctacgtagccacgaccggtgctcgatttagtgtagtgtgaagggaaaggggaagaccgatgggcccttggtgaagccttcggagaccctgtccctcacctgcactgtctctggtgactccatcagtccttactactggacctggatccggcagcccccagggaagggactggagtggattggatatatctattacagtggggcaccaactacaacccctcctcaagagtcgagtcatcatttcagtagacacgtccaagaaccagttctccctgaagatgagctctgtgaccgccgctgacacggccgtctattatgtgcgagacatcggcacctaagttggtcgaccctggggccaggggaacccggtcaccgtcgcctcacgcctccaccaagggcccatccgggtccttccccctggccaccctcctccaagcgcacctcgnggggcacgngcgcctggctgcctgtcaaggactacgttccgctacgtacgactgacggcgggctcggcgaacggcgcaagngnnnnnnn

SEQ ID NO: 357824 - DNA, 598 bp, Homo sapiens
  misc_feature: GZ8MTXP02HZEYN.15.70.G04.1.454.CMB.2.raw
  modified_base (592)..(598): a, c, t, g, unknown or other
  misc_feature (592)..(598): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcagcccccagggaagggactggagtggattggatatatctattacagtggggcacaactacaacccctcctcaagagtcgagtcatcatttcagtagacacgtccaagaaccagttctccctgaagatgagctctgtgaccgccgctgacacggccgtctattattgtgcgagacatcggctacctaagttggttcgaccccgtggggccacggggacccggtcaccgtcgcctcacgcctcccaccgaacggggccccattcccgggtccttcccccgtggcccacccctccctcccaaagcgtccacccgtcgtcgggggccaacgcggccgggcccccgttgggggcccttgggacccctgggtaccaaacgggtcctacgttcccgactaccgtagactggacggcggcgtggacaacgggcactaagtagnnnnnnn

SEQ ID NO: 357825 - DNA, 558 bp, Homo sapiens
  misc_feature: GZ8MTXP02IEKRM.15.70.G04.1.454.CMB.2.raw
  modified_base (552)..(558): a, c, t, g, unknown or other
  misc_feature (552)..(558): n is a, c, g, or t
tcagtctacgtagccacgaccggtgctcgatttagtgtagtgtgaagggaaaggggaagaccgatgggcccttggtgaagccttcggagaccctgtccctcacctgcactgtctctggtgactccatcagtccttactactggacctggatccggcagccccagggaagggactggagtggattggatatatctattacagtggggcaccaactacaacccctcctcaagagtcgagtcatcatttcagtagacacgtccaagaaccagttctccctgaagatgagctctgtgaccgccgctgacacggccgtctatttattgtgcgagacatcggcacctaagttggtcgacccgtggggccaggggacccgggcaccggtcgcctcacgcctccaccgacgggcccatcccggtcctttcccccgcggccaccctccctcccaagacgcacccgtctcgggggcacgacgccggccccgtggggcctgcccgtcggtcaaaggctacgttccgctacgtacgactgagcggcgtcggcgacgcgcaagannnnnnn

SEQ ID NO: 357826 - DNA, 613 bp, Homo sapiens
  misc_feature: GZ8MTXP02G95FE.15.70.G04.1.454.CMB.2.raw
  modified_base (403)..(403): a, c, t, g, unknown or other
  misc_feature (403)..(403): n is a, c, g, or t
  modified_base (607)..(613): a, c, t, g, unknown or other
  misc_feature (607)..(613): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcagcccccagggaagggactggagtggattggatatatctattacagtggggcaccaactaccaacccctcctcaagagtcgagtcatcatttcagtagacacgtccaagaaccagttctccctgaagatgagctctgtcgaccgccgctgacgacggccgtctattatgtgcgagacagtcggacaccgttaagttcggtccgacccgtcggggccgaacggggaccccggtcgaccgtcgcctcncgccctcccgacgaacgggccctacgtcccggtcccttcccccgtcggcccacccctccctacccgaacgacgccacccgtccggtacgggggccaccgacggccggcccgtgggctcggaccgtggtaccgaaacgggtactaaccgttccgacgtacgtacgtaccgtaggcggcgggcgtcggacgaacggcgacaagtgnnnnnnn

SEQ ID NO: 357827 - DNA, 603 bp, Homo sapiens
  misc_feature: GZ8MTXP02GQVP3.15.70.G04.1.454.CMB.2.raw
  modified_base (598)..(603): a, c, t, g, unknown or other
  misc_feature (598)..(603): n is a, c, g, or t
tcagtctacgtagccacgaccggtgctcgatttagtgtagtgtgaagggaaagggggaagaccgataagggcccttggtgaagccttcggagaccctgtccctcacctgcactgtctctggtgactccatcagtccttactactggacctggatccggcagcccccagggaagggactggagtggattggatatatctattacagtggggcaccaactaccaacccctcctcaagagtcgagtcatcatttcagtagacacgtccaaagaaccagttcctccctgaagatgagctctgtcgaccgccgctgaccacggccgtcttattattgtgcgagacatcggctaccgtaagttcggtccgaccccgtggggcccacggggaaccccggtccaccggtccgcctcgacgccctaccaccgacgggcccagtcccggtccctcccccgtcggcccaccctccctcccacgacgccacccgtcgtcggggccacgacggccggcccgtgggctcggccgtcggacgaacggccttacgtccgtactacgtacgtacgtgacggccgggcgtcgggacgaacggccgacgaagacgcnnnnnn

SEQ ID NO: 357828 - DNA, 628 bp, Homo sapiens
  misc_feature: GZ8MTXP02HASJ9.15.70.G04.1.454.CMB.2.raw
  modified_base (333)..(333): a, c, t, g, unknown or other
  misc_feature (333)..(333): n is a, c, g, or t
  modified_base (621)..(621): a, c, t, g, unknown or other
  misc_feature (621)..(621): n is a, c, g, or t
  modified_base (623)..(624): a, c, t, g, unknown or other
  misc_feature (623)..(624): n is a, c, g, or t
  modified_base (626)..(628): a, c, t, g, unknown or other
  misc_feature (626)..(628): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcacgcccccagggaagggactggagtggattggatatatctattacagtggggcaccaactaccaacccctcctcaagagtcgagtcatcatttcagtagacacgtccaagaaccagttctccctgaagatgagctctgtcgaccgccgctgaccacggccgtctattatgtgcganacagtcggcacctaagttcggtccgacccgtcggggccacggggaccccggtcaccggtccgcctcacgccctaccaccgaacgggcccagttcccggtcccttcccccgtcggcccaccctccctacccgaacgaccgccaccgtccgtacgggggccaaccgcggcccgggcccgttcgggccgtcggcccgtcggttaccgaaacgggtaccttaaccgttccgaccgttaacgtacggtaacgtcggacggcgggcgtacgggaccgaacggcgacaagtagcncnncnnn

SEQ ID NO: 357829 - DNA, 685 bp, Homo sapiens
  misc_feature: GZ8MTXP02I0Z57.15.70.G04.1.454.CMB.2.raw
  modified_base (335)..(335): a, c, t, g, unknown or other
  misc_feature (335)..(335): n is a, c, g, or t
  modified_base (679)..(682): a, c, t, g, unknown or other
  misc_feature (679)..(682): n is a, c, g, or t
  modified_base (684)..(685): a, c, t, g, unknown or other
  misc_feature (684)..(685): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcagcccccagggaagggactggagtggattggatatatctattacagtggggcaccaactacaacccctcctcaagagtcgagtcatcatttcagtagacacgtccaagaaccagttcctccctgaagatgagctctgtcgaccgcccgctcgaaccacggccgtcttatttacttggngcgagacagtcggcctaaccgttaaagtttcggttaccgacccccgttgggggacccctaacgggggaaacccccgggttccaacccggttcccggccccttccgaaccggtcccccttacccgaacccgaaacgggggcccccaagttcccgggttccctttccccccgttcggccctacccccgttccctacccgaaacgtaccgccaacccgtccgtcgggggccaaccgacgcccgggccccgtggggtcctcggtcccgtcggtacgaacgggtaccttaaccgtccgtacgtacgtacgacgtcgacggcgggcgtcggcgaacggcgacgaagtagnnnncnn

SEQ ID NO: 357830 - DNA, 632 bp, Homo sapiens
  misc_feature: GZ8MTXP02IWRM0.15.70.G04.1.454.CMB.2.raw
  modified_base (276)..(276): a, c, t, g, unknown or other
  misc_feature (276)..(276): n is a, c, g, or t
  modified_base (627)..(632): a, c, t, g, unknown or other
  misc_feature (627)..(632): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcagcccccagggaagggactggagtggattggatatatctattacagtggggcaccaactacaacccctcctcaagagtcgagtcatcatttcagtagacacgtccaagaaccagttccnccctgaagatgagctctgtcgacccgccgctgaccacggccgtcttatttagttgtgcgagacagtcggcaccgttaagttggtcgaccccgtggggacccacggggacccggtcaccgtccgcctgacgccctacccaaccgaacggggccccagttcccgtcccttccccgtcggccaccctccctacccaaagaccgcacccgtcgtcgggggccacgacggccggcccgtggggcctcggcccgtcgggtaccgaaacgggtaccttaaccgtttcccggacttaacggttacgaaccgttacggagggccggggtcgcggaccgaaacgggccgacgaacgagacnnnnnn

SEQ ID NO: 357831 - DNA, 588 bp, Homo sapiens
  misc_feature: GZ8MTXP02GR51Q.15.70.G04.1.454.CMB.2.raw
  modified_base (582)..(585): a, c, t, g, unknown or other
  misc_feature (582)..(585): n is a, c, g, or t
  modified_base (587)..(588): a, c, t, g, unknown or other
  misc_feature (587)..(588): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcagcccccagggaagggactggagtggattggatatatctattacagtggggcaccaactacaacccctcctcaagagtcgagtcatcatttcagtagacacgtccaagaaccagttctccctgaagatgagctctgtcgaccgccgctgacacggccgtctattattgtgcgagacatcggctacctaagttcgtcgacccgtgggccgagggacccggtcaccgtccgcctcacgccctccaaccgacggggccccagttcccggtcccttcccccgtcggccctacccctccctacccaacgacgccaccgtcgtcgggggcacgacgccggcccgtgggctcgccgtcgtcgaacggtactacgttcccgctacgtacgaccgtgacggccgggcgtcgggacgaacggcgacgaagtagcnnnncnn

SEQ ID NO: 357832 - DNA, 575 bp, Homo sapiens
  misc_feature: GZ8MTXP02HN0JB.15.70.G04.1.454.CMB.2.raw
  modified_base (233)..(233): a, c, t, g, unknown or other
  misc_feature (233)..(233): n is a, c, g, or t
  modified_base (446)..(446): a, c, t, g, unknown or other
  misc_feature (446)..(446): n is a, c, g, or t
  modified_base (569)..(575): a, c, t, g, unknown or other
  misc_feature (569)..(575): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcagcccccagggaagggactggagtggattggatatatctattacagtggggcaccaactacaacccctcctcaagngtcgagtcatcatttcagtagacacgtcaagaaccagttctccctgaagatgagctctgtcgaccgccgctgacacggccgtctatattgtgcgagacagtccggactaccgtaaagttcggttccgaccccgtgggggacccaaggggaccccgggtcaccggtcgcctcacgcctccaccgaacgggcccagttcccggtccttcccccgnggccctacccctcctaccaagacgccaccctcgtcggggaccacgacgccggccgtgggctcgccgtgcaaggctcgttcgctacgtacgactggagcgggctggccaaggtccgctaagagnnnnnnn

SEQ ID NO: 357833 - DNA, 587 bp, Homo sapiens
  misc_feature: GZ8MTXP02HW8WW.15.70.G04.1.454.CMB.2.raw
  modified_base (384)..(384): a, c, t, g, unknown or other
  misc_feature (384)..(384): n is a, c, g, or t
  modified_base (581)..(587): a, c, t, g, unknown or other
  misc_feature (581)..(587): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcagccccagggaagggactggagtggattggatatatctattacagtggggcaccaactacaacccctcctcaagagtcgagtcatcatttcagtagacacgtccaagaaccagttctccctgaagatgagctctgtgacccgccgctgaccacggcccgtctattattgtgcgagacatcggcacctaagttggtccgacccgtggggcccaggggaaccccgggtnacccggtcgcctcacgccctcccaccgaaggggccccagtccggtccttccccgtcggccctaccccgtccctccaacgcgcaccctcgtcgggggcacgacggccggccccgtcggggcctcggccgtcgggtacaaggactaacgtttcccgactacgtagactggacgcgggctggccgaaggcgacgaagtgnnnnnnn

SEQ ID NO: 357834 - DNA, 608 bp, Homo sapiens
  misc_feature: GZ8MTXP02FM1PO.15.70.G04.1.454.CMB.2.raw
  modified_base (604)..(608): a, c, t, g, unknown or other
  misc_feature (604)..(608): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcagcccccagggaagggactggagtggattggatatatctattacagtggggcaccaactacaacccctcctcaagagtcgagtcatcatttcagtagacacgtccaagaaccagttctccctgaagatgagctctgtgaccgccgctgacacggccgtctattattgtgcgagacatcggcacctaagttggttcgacccctggggccaggggaacccggtcaccgtccgcctcacgccctccaaccgaacgggcccagtccggttccttcccccgtcggcccacccctcctcccaacgacgcacctcgtgggggccacgaggccggcccgtgggcctcggccgtacggtaccgaaacggtaccttaaccgttcccgacttaccggttaagaccgttacggacggccggggtcgttcggccgaaaacgggcgaccgaagtaggcgcnnnnn

SEQ ID NO: 357835 - DNA, 660 bp, Homo sapiens
  misc_feature: GZ8MTXP02I1QLO.15.70.G04.1.454.CMB.2.raw
  modified_base (651)..(651): a, c, t, g, unknown or other
  misc_feature (651)..(651): n is a, c, g, or t
  modified_base (654)..(655): a, c, t, g, unknown or other
  misc_feature (654)..(655): n is a, c, g, or t
  modified_base (657)..(657): a, c, t, g, unknown or other
  misc_feature (657)..(657): n is a, c, g, or t
  modified_base (659)..(660): a, c, t, g, unknown or other
  misc_feature (659)..(660): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcagcccccagggaaggactggagtggattggatatatctattacagtggggcaccaactacaacccctcctcaagagtcgagtcatcatttcagtagacacgtaccaaagaaccagttcctccctgaaagatgagtctcgtgtcgacccgtccgctcgaccgacggtccgttactatttactgtgcgagacagtcggactaacgttaagttcggtccgtacccgtcggggaccacggggaccccggtcacccggtccggacctcgacgtcccctaccaaccgaccgggcccagttcccggttcccttcccccgcggaccctaccccctccgtacccgaaagccgcctacccgttcgggcggggaccaaaccggcggcccggtccgttgggccttcggaccttcgggacgaacggtaccttaccgttcccgacgtttaacgacgtacgagggacggcccgggtgacggaccggaaacgggttccaagaacgttggngcnncncnn

SEQ ID NO: 357836 - DNA, 706 bp, Homo sapiens
  misc_feature: GZ8MTXP02G7TZ8.15.70.G04.1.454.CMB.2.raw
  modified_base (340)..(340): a, c, t, g, unknown or other
  misc_feature (340)..(340): n is a, c, g, or t
  modified_base (704)..(705): a, c, t, g, unknown or other
  misc_feature (704)..(705): n is a, c, g, or t
tcagtctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcacgccccagggaagggactggagtggattggatatatctattacaggtggggcaccaactaccaacccctccctcaagagtcgagtcatcatttcagtagacacgtaccaagaaccagttcctccctagaacgatgagctctgtcgacccgccgctagaccgacggccgttcttattattggngcgaagacacgtcggctaaccgttaaaggtttcggtaccggaccccgtgggggacccgacggggtaaccccgggctacccggtccgaccctcgaccgccctaccgaccgaacgggccctacgtcccggtccttccccgtcggcctacccgtccctaccgaagtccgaccgtaccgtcggcgggggaccaccgcgggtccccgggtcccggcggggtacccgtcgggtccgttacgggtaccgtaacgggtacccttacgtttcccggaccgtaacggtacgtaccggttacggggacgggtaccggggttccggtaggggacccggaagggccccggtaacggtaacgtacggcgcgcgcgcgnng

SEQ ID NO: 357837 - DNA, 502 bp, Homo sapiens
  misc_feature: GZ8MTXP01D6SJ9.17.44.D11.1.454.CMB.2.raw
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatgtaaatggtatcagcagaaaccagggaaagcccctaaagttcctgatctatgctgcatccagtttacaaagtgggtccatcgagttcagtggnagtggatcngggcagatttcactctcaccatcagcagtgtgacaacctgaagtatttgacaacttactactggtacaactagaaattacaactacccctcgtaactttgccaggggaccaagctggagattacaaacgaacttagttggctgcaaccatcttgtcttctaac

SEQ ID NO: 357838 - DNA, 524 bp, Homo sapiens
  misc_feature: GZ8MTXP01BG1Y5.17.44.D11.1.454.CMB.2.raw
  modified_base (164)..(164): a, c, t, g, unknown or other
  misc_feature (164)..(164): n is a, c, g, or t
  modified_base (512)..(512): a, c, t, g, unknown or other
  misc_feature (512)..(512): n is a, c, g, or t
  modified_base (523)..(523): a, c, t, g, unknown or other
  misc_feature (523)..(523): n is a, c, g, or t
tcagcgtagactagcacgaccggtgctcgatttagcgcagtacgaaggggagtcagtctcagtcaggacacagcatggacatgagggtcccgctcagctcctggggctcctgctactctggctccgaggtgccagatgtgacatccagatgacccagtttcccncctccctgtctgcgtctataggagacagagtcaccatcacttgccgggcaagtcagagcaattaacagatatgtaaattggtatcagcaagaaaccagggaaacgccctaaagtcctgatctatgctgcatccagtttacaaagtgggtcccatcgagttcagtggcagtggatcgtgggcagtatttcactctcaccatcagcagtgtgactaacctgaagtatttgactaacttactacctgggtactaaactaataattaacaacgtacccctacgtaacttttggaccgacggggaccaaagcctagggatacttacgaaacggtaacttgttggactgcaacntcttctcttcnc

SEQ ID NO: 357839 - DNA, 507 bp, Homo sapiens
  misc_feature: GZ8MTXP01AB2NK.17.44.D11.1.454.CMB.2.raw
  modified_base (166)..(166): a, c, t, g, unknown or other
  misc_feature (166)..(166): n is a, c, g, or t
  modified_base (267)..(267): a, c, t, g, unknown or other
  misc_feature (267)..(267): n is a, c, g, or t
  modified_base (416)..(416): a, c, t, g, unknown or other
  misc_feature (416)..(416): n is a, c, g, or t
  modified_base (480)..(480): a, c, t, g, unknown or other
  misc_feature (480)..(480): n is a, c, g, or t
  modified_base (497)..(497): a, c, t, g, unknown or other
  misc_feature (497)..(497): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttcccnctccctgtctgcgtctataggagacagagtcaccatcacttgccgggcaagtcagagcattaacagatatgtaaattggtatcagcagaaaccagggaaancccctaaagtcctgatctatgctgcatccagtttacaaagtggggtccatcgaggttcagtggcagtggatctgggcagatttcactctcacatcagcagtgtgcaacctgaagtattttagctaaacttactactggtacaaacgtanaaactttaacaaactacccctcgtaactttggccaggggaccaagctggagattcgaaacgacngttggctgcaaccatcngtcttctaac

SEQ ID NO: 357840 - DNA, 517 bp, Homo sapiens
  misc_feature: GZ8MTXP01ACPS2.17.44.D11.1.454.CMB.2.raw
  modified_base (215)..(215): a, c, t, g, unknown or other
  misc_feature (215)..(215): n is a, c, g, or t
  modified_base (266)..(266): a, c, t, g, unknown or other
  misc_feature (266)..(266): n is a, c, g, or t
  modified_base (412)..(412): a, c, t, g, unknown or other
  misc_feature (412)..(412): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggnaagtcagagcattaacagatatgtaaattggtatcagcagaaccagggaanccctaagtcctgatctatgctgcatccagtttacaaagtgggtccatcgagttcagtggcagtgatcgtgggaacagtatttcactctcaccatcagcagtgtgcaacctgaagtatttagactaacttactactggtacaaacanaaacttacaactacccctacgtactttcggccgtaaggggaccaagctaggatacttacgaaacgtaacgttgttgctgcaactatcttcgtaacttcgtaaccc

SEQ ID NO: 357841 - DNA, 511 bp, Homo sapiens
  misc_feature: GZ8MTXP01B7JSG.17.44.D11.1.454.CMB.2.raw
  modified_base (346)..(346): a, c, t, g, unknown or other
  misc_feature (346)..(346): n is a, c, g, or t
  modified_base (475)..(475): a, c, t, g, unknown or other
  misc_feature (475)..(475): n is a, c, g, or t
  modified_base (499)..(499): a, c, t, g, unknown or other
  misc_feature (499)..(499): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatgtaaattggtatcagcagaaaccgagggaaacgcccctaagttcctgatctatgctgcatccagtttacaaagtcggggtccagtcgaggttcagtggcagtggatcgngggcagtatttcactctcaccatcagcagtgtgacaacctgaagtatttagactaacttactactggtacaacagtaacttacaactacccctccgtactttcggccgacgggtaccaagctaggaganacgaaacgacttgttgctgcaacntcttgtcttctc

SEQ ID NO: 357842 - DNA, 568 bp, Homo sapiens
  misc_feature: GZ8MTXP01CNM0U.17.44.D11.1.454.CMB.2.raw
  modified_base (190)..(190): a, c, t, g, unknown or other
  misc_feature (190)..(190): n is a, c, g, or t
  modified_base (272)..(272): a, c, t, g, unknown or other
  misc_feature (272)..(272): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctatagganacagagtcaccatcacttgccgggcaagtcagagcaattaacagatatagtaaattggtatcagcaagaaaccagggaaacncccctaaagttcctgatctatgctgcatcctagtttacaaagtgggtccagtcgaggttcagtggcagtgatcgtgggcagtatttcactctacacatcagcagtgtacgacaaccgttagaagttattttcgacttaaacttactaactacggtacaaacgtataaacttaaccaaacttaccccttcgtaaacgttttcggaccgtaacggggaaccaaggccgttaggaagtacttacgaaaaacgtacttggttggacttggacctaaccaattccttatccttcgtaaccc

SEQ ID NO: 357843 - DNA, 542 bp, Homo sapiens
  misc_feature: GZ8MTXP01B1WOH.17.44.D11.1.454.CMB.2.raw
  modified_base (377)..(377): a, c, t, g, unknown or other
  misc_feature (377)..(377): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatgtaaattggtatcagcaagaaaccagggaaacgcccctaaagttcctgatctatgctgcatcctagtttaacaaaggtcggggtaccatcgaggttcacgtggcagtgatctagggcagtatttcactctacaccatcancagtgtgactaaacctgaagtatttagactaaacttactactggtactaaacaagtaacttaacaacttacccctaccgtactttcggaccgtaggggaccaaggtaactgggacgacttaacgaaacggtaattggttggctgcaacctatcttctcttctaac

SEQ ID NO: 357844 - DNA, 566 bp, Homo sapiens
  misc_feature: GZ8MTXP01AICR4.17.44.D11.1.454.CMB.2.raw
  modified_base (215)..(215): a, c, t, g, unknown or other
  misc_feature (215)..(215): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggnaagtcagagcattaacagatatgtaaattggtatcagcagaaacagggaaagcccctaaagtcctgatctatgctgcatccagtttacaaaggtcgggtccatcgagttcagtggcagtgatctgggaacagatttcactctcacatcagcagtgtgacaacctgaagtattttgactaaacttactactaggtacaaacgtagtaaactttaaccaactacccccgtcgttaacgttttcggaccgtaagggggacccaaaggtccgtaagggaagtaacgttaacgaaaacgtaacgttggttcgggttaccttggacccaactactcgttcgttaaccttcgtaaccg

SEQ ID NO: 357845 - DNA, 569 bp, Homo sapiens
  misc_feature: GZ8MTXP01DAP43.17.44.D11.1.454.CMB.2.raw
  modified_base (270)..(270): a, c, t, g, unknown or other
  misc_feature (270)..(270): n is a, c, g, or t
  modified_base (347)..(347): a, c, t, g, unknown or other
  misc_feature (347)..(347): n is a, c, g, or t
  modified_base (412)..(412): a, c, t, g, unknown or other
  misc_feature (412)..(412): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgaccctagtttccctcctccctgtctgcgtctataggagacagatcacatcacttgccgggcaagtcagagacaattaacagatatagtaaattggtatcagcaagaaacaggaaacnccctaaagttccagatctatgctagctaatacctaagtttaacgaaaggtcgggtacccagtcggagttcagtcggnaggtgatcgagggctagtattcactcacacatcagcagtgtacgactaaacgtgtaagtatttanacttaaacttactaatacgtacaaactaataaacttaactaacctaccccgtacgttaaccgtttcggacccgtaggggaacccaagtcgtaggaacgacttaacgaaaacgtacttggcgacgtcgactaaccctatcttagttccttcgtaaccc

SEQ ID NO: 357846 - DNA, 558 bp, Homo sapiens
  misc_feature: GZ8MTXP01CCRWD.17.44.D11.1.454.CMB.2.raw
  modified_base (166)..(166): a, c, t, g, unknown or other
  misc_feature (166)..(166): n is a, c, g, or t
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (274)..(274): a, c, t, g, unknown or other
  misc_feature (274)..(274): n is a, c, g, or t
  modified_base (336)..(336): a, c, t, g, unknown or other
  misc_feature (336)..(336): n is a, c, g, or t
  modified_base (374)..(374): a, c, t, g, unknown or other
  misc_feature (374)..(374): n is a, c, g, or t
  modified_base (396)..(396): a, c, t, g, unknown or other
  misc_feature (396)..(396): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttcccncctccctgtctgcgtctatagganacagagtcaccatcacttgccgggnaagtcagagcaattaacagatatagtaaattggtatcagacaagaaaccgagggaaacncccctaaagttcctagatctatgctgcatccagtttacaagtcggtccatcgagttcagtgnagtgatcgtgggaacagtactttcactctacacatcancagtgtgactaactagtaactntttagactaacttactactggtacaaacagtaaacttaacaactaccccgttacgtaaccgtttcggacccgaaggggtacccaaggtccgtagggacgtaaacttacgaaaacgtacgttggttcggcttcgactaactactcgttcttaaccttctaacc

SEQ ID NO: 357847 - DNA, 637 bp, Homo sapiens
  misc_feature: GZ8MTXP01B8KV9.17.44.D11.1.454.CMB.2.raw
  modified_base (217)..(217): a, c, t, g, unknown or other
  misc_feature (217)..(217): n is a, c, g, or t
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatcgaccctagtttcccctcctccctgtctgcgtctataggagacagagtcaccatcacttgccggnaagtcagagcaattaacagtatatagtaaattggtatcagacaagaaaccgagggaaacnccctaattccngatctatcgctgactatacctaagtttaacgaaaggttcgggtacccagttcggtaggttcaggtggacagggtgatcgtagggaacagttacttccactcgtacaccatcagactaggtcgtacgacctaacgtagtaaagttatttacgaacttaacttactacgtagttactaaacgtaactaaacttaaccaacccttaccccgttaccggttaaccgtttcggaccggaacggggtaaccaaggtaaccgtaagggttaacgtaaacgttaaccgaaaacggtacgttaggttcggttacgtaacgacctaacctaacttcgttacgttcccttcgttaacccg

SEQ ID NO: 357848 - DNA, 551 bp, Homo sapiens
  misc_feature: GZ8MTXP01DGB42.17.44.D11.1.454.CMB.2.raw
  modified_base (166)..(166): a, c, t, g, unknown or other
  misc_feature (166)..(166): n is a, c, g, or t
  modified_base (281)..(281): a, c, t, g, unknown or other
  misc_feature (281)..(281): n is a, c, g, or t
  modified_base (336)..(336): a, c, t, g, unknown or other
  misc_feature (336)..(336): n is a, c, g, or t
  modified_base (519)..(519): a, c, t, g, unknown or other
  misc_feature (519)..(519): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttcccncctccctgtctgcgtctataggagacagagtcacatcacttgccgggcaagtcagagcattaacagatatgtaaattggtatcagacaagaaaccaggaaacgccctaagttccngatctatgctgcatcctagtttaacaaaggtcgggtccaagtcgagttcagtggntagtggatcgtgggaacagtacttcactctacacatcagcagtgtagacaacctagaatagtttacactaaacttactactacggtacaaacgtaagtaaacttaactaaaccttacccctaccgttacgttttacggaccgtacgggaaccaagctaggagacttacgaaacgtaacgttgngcgtcgactaacgtactcttcttcttctaacc

SEQ ID NO: 357849 - DNA, 661 bp, Homo sapiens
  misc_feature: GZ8MTXP01A3FX3.17.44.D11.1.454.CMB.2.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
tcagcgtagactagcacgaccggtgctcgatttagcgcagtacgaagggggagtcagtctcagtcaggacacagcatggacatggacgggtccccgctcagctccgtggggctcctgctactctggctccgaggtgccagatgtgacatccagatcgaccctagtttcccctcctccctgtctgcgtctatagganacagagtcaccatcacgttggccggganaagtcagagacaattaacagtattatagtaaattggtatcagacaagaaaccgagggaaactcccctaaagttccagtactctatcgctgactatcctaagtttaacgaaaggtcgggtacccagtcgaggttcaggtggactaggtggatcggtagggaacagtactttcactctaccactatacagctaggtgtacgactaaccgtagtaagttatttacgactaactttactaccttagggtaactaaactaagtaaacttaacctaaacccgttaccccgttaccgttaaccggttttacggacccggtaacggggtaacccgaacggtaaccgtaagggaacgtaacttaaccggtaaaacgtaacgttcgggttcggttaccgtaacggacctaaccgttacttccgttacgttcgttaaccgttaacccg

SEQ ID NO: 357850 - DNA, 527 bp, Homo sapiens
  misc_feature: GZ8MTXP01BH2A6.17.44.D11.1.454.CMB.2.raw
  modified_base (266)..(266): a, c, t, g, unknown or other
  misc_feature (266)..(266): n is a, c, g, or t
  modified_base (471)..(471): a, c, t, g, unknown or other
  misc_feature (471)..(471): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatgtaaatggtatcagcagaaccagggaaanccctaaagtcctgatctatgctgcatccagtttacaaagtgggtcccagtcgaggttcagtggcagtggatcgtgggaacagtatttcactctcacatcagcagtgtgacaactgaagtatttagactaacttactactggtacaacaagtaacttacaacttacccctcgtacgtttcggccgtaagggaccaagtctaggaanacgttaacgaaacgtacgttgttcggctcgacctaacctatcttcgtcttcgtaac

SEQ ID NO: 357851 - DNA, 558 bp, Homo sapiens
  misc_feature: GZ8MTXP01A5AMI.17.44.D11.1.454.CMB.2.raw
  modified_base (190)..(190): a, c, t, g, unknown or other
  misc_feature (190)..(190): n is a, c, g, or t
  modified_base (347)..(347): a, c, t, g, unknown or other
  misc_feature (347)..(347): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctatagganacagagtcaccatcacttgccgggcaagtcagagcaattaacagatatgtaaattggtatcagcaagaaaccgagggaaacgcccctaaagttcctagatctatgctgactatcctaagtttacaaaggtcggggtacccagtcgaggttcagtggnagtggatcgtagggcagtatttcactctacacatcagcagtgcgactaactagtaagtactttacgactaacttactactaggtaacaaactagtaaacttaaccaacctacccttaccgtatttccggaccgtacggggacctaggctacggataacgttacgaaaacgacgttgcggttactcgacaactatcttacgtccttctaacc

SEQ ID NO: 357852 - DNA, 577 bp, Homo sapiens
  misc_feature: GZ8MTXP01AJCNO.17.44.D11.1.454.CMB.2.raw
  modified_base (166)..(166): a, c, t, g, unknown or other
  misc_feature (166)..(166): n is a, c, g, or t
  modified_base (267)..(267): a, c, t, g, unknown or other
  misc_feature (267)..(267): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttcccnctccctgtctgcgtctataggagacagagtcaccatcacttgccggcaagtcagagcattaacagatatgtaaattggtatcagcaagaaccagggaaacncccctaaagttcctagatctatgctgcatcctagtttacaaggtcgggtccagtcgaggttcaggtggcaggtcgatcgtagggaacagtattcactcgtacaccatcagacagtgtacgactaaccgtagtaagtactttgactaacttacttacgtggttacaaacgtaataaacttaacaaacctaccccgttacgtaaccgttttcggaccgtaacggggtaccaacggtcgtagggaacgtacttaacgaaaacgtacgttaggttcgggacgtcacaacctatcgttcgttcgttaactaaccg

SEQ ID NO: 357853 - DNA, 586 bp, Homo sapiens
  misc_feature: GZ8MTXP01AO6E1.17.44.D11.1.454.CMB.2.raw
  modified_base (192)..(192): a, c, t, g, unknown or other
  misc_feature (192)..(192): n is a, c, g, or t
  modified_base (349)..(349): a, c, t, g, unknown or other
  misc_feature (349)..(349): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgaccctagtttcccctcctccctgtctgcgtctatagganacagatcaccatcacttggccgggcaagtcagagcaattaacagatatagtaaattggtatcagcaagaaaccgagggaaactccccttaagtcctagacttctatcgctgctatccgtaagtttacgaaggtcgggtaccagtcgagttcagtggnagtgatcgtagggaactagtactttcactctacactatcagctagtcgtacgactaacgtgtaagtatttacgacttaacttactactacggtacaaacgtaataacttaaccaaccttaccccgttacgttacgtttacggaccgtaacgggtaccaaggtcgtagggaacgtacttaacgtaaacgtaacgttggttcggactcgacctaactacttcgttcgttcttctaaccg

SEQ ID NO: 357854 - DNA, 607 bp, Homo sapiens
  misc_feature: GZ8MTXP01DRDB1.17.44.D11.1.454.CMB.2.raw
  modified_base (588)..(588): a, c, t, g, unknown or other
  misc_feature (588)..(588): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagatcacatcacttgccgggcaagtcagagctaattaacagattaatgttaaattggtatcagacaagaaacccgagggaaactcccctaaagttccagatctatcgctgactatcctaagttttacgaaaggtcgggggtacccaagttcggaggttacaggtcggactaggtggaatcgtaggggaactagtactttccaacttcacaactatcgaagtctaggtcgtcgaacctaaacgttaggtaaattagttttagaacctaactttaacgtaccttaggtaacaaagtaaactaaacttaaacctaaccttaccccgttacgttacgttttaccggccgtaacggggtacaagtcgtagagtacttacgaaacgtacttagttgctgacnctactcttctcttctaacc

SEQ ID NO: 357855 - DNA, 569 bp, Homo sapiens
  misc_feature: GZ8MTXP01BN1VU.17.44.D11.1.454.CMB.2.raw
  modified_base (166)..(166): a, c, t, g, unknown or other
  misc_feature (166)..(166): n is a, c, g, or t
  modified_base (274)..(274): a, c, t, g, unknown or other
  misc_feature (274)..(274): n is a, c, g, or t
  modified_base (384)..(384): a, c, t, g, unknown or other
  misc_feature (384)..(384): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttcccncctccctgtctgcgtctataggagacagagtcaccatcacttgccgggcaagtcagagctaattaacagatatagtaaattggtatcagcaagaaaccgagggaaacncccctaaagtcctagatctatgctgctatcctaagtttacgaaggtcggggtacccagtcgaggttcgagtggcaggtggatcgtgggctagtactttcactctcactancagcagtgtcgactaacgtgtaacgtatttacgactaacttactacgtaggtaacaagtaacgtaacttaacctaaccttaccccttacgttacgtttcggaccgtacgggtaccaagcgtaggagtacgttacgaaacgtacgttggttcgctcgacaacctactcttcgttccttcgtaaccc

SEQ ID NO: 357856 - DNA, 590 bp, Homo sapiens
  misc_feature: GZ8MTXP01C5WYO.17.44.D11.1.454.CMB.2.raw
tcagcgtagactagcacgaccggtgctcgatttagcgcagtacgaaggggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatgtaaattggtatcagcagaaacagggaaacgcccctaagtcctgatctatgctgcataccagtttacgaaaggtcgggggtacccagtcggaggttcagtggcagtggatcgtagggcagtatttcactctacacatcagcagtgtgacaactagaagtatttgactaacttactacttacggtactaaactaagtaaacttaacctaaaccttacccccttaccggttaccgttttacgggacccggtaacgggggacccaaaggtcgtagggacgtaacgttaaccgtaaacgtaacgttggttcgggccgttcggacctaacctattccttacgttccttccgttaacc

SEQ ID NO: 357857 - DNA, 717 bp, Homo sapiens
  misc_feature: GZ8MTXP01BZF7M.17.44.D11.1.454.CMB.2.raw
  modified_base (221)..(221): a, c, t, g, unknown or other
  misc_feature (221)..(221): n is a, c, g, or t
  modified_base (260)..(260): a, c, t, g, unknown or other
  misc_feature (260)..(260): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatcgaccctagtttcccctcctccctgtctgcgtctataggagacagagtcaccatcacgttggccggganaagtcagagactaattaacagtatatagtaaattggtancagacaacgaaaccgaagggaaactccccttaaagttcctagtatactatcgctagactacttaccgtaagttttaacgaaaggttcggggtaccccagtacggtaggttcaggtggactaggtaggacttacggtagggaactagttactttccgacttccgtacaaccctataccgagtaccgtaggtacgtacgtaaccctaaaccgtaggtaaacgttagttttacgtaaccttaaacttacttaaccgtacggttaacctaaacgtaaacgtaaacctttaaacccaaaccctttaccccgttaaccggttacgttttaccgggaacccggtaacggggaacctaacggtaacgtaggaaacgtaacgaaccgtaaaaccggtacgttcgggttcggaccgttaacggaccctaaccgttacttacttaccggttcctttcccgttaacccg

SEQ ID NO: 357858 - DNA, 621 bp, Homo sapiens
  misc_feature: GZ8MTXP01D3Y84.17.44.D11.1.454.CMB.2.raw
  modified_base (279)..(279): a, c, t, g, unknown or other
  misc_feature (279)..(279): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctagtaggagacagatcaaccatcacttcggccgggacaaagtcagagctaattaacagattatagtaaattggatcagacaagaaaccagggaaacnccctaagttcagatctatgctgactatacctaagtttaacgaaaggtcgggtaccctagtcggtagttcaggtggacgtaaggtcggatcgtagggaacagttactttcactctacactagtcagctaagtgagtactaaacgttagtaaagtttactttaactaaaccttaacttaactacgtaacgtaaactaagtaaaccttaaactaacccttaccccgttacgttaacgtttacgggaccgtaaacgggggtaccaaggtcgaaggaacgaataaccgaaaacgtacgtcggttaggcttacgaacctaatcgttctcttactttcaacgtttcccc

SEQ ID NO: 357859 - DNA, 562 bp, Homo sapiens
  misc_feature: GZ8MTXP01EM8N6.17.44.D11.1.454.CMB.2.raw
  modified_base (249)..(249): a, c, t, g, unknown or other
  misc_feature (249)..(249): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
tcagcgtagactagcacgaccggtgctcgatttagcgcagtacgaaggggggagtcagtctcagtcaggacacagcatggacatgagggtccccgctcagctcctggggctcctgctactctggctccgaggtgccagatgtgacatccagatcgaccctagtttcccctcctccctgtctgcgtctataggagacagacgtaccaccatcctacgttcggacccgggacaagtcagagactaattaanagtatatagtaatggatcagacaagaacgaggaaactccctagtcngtatctangctnacacttacgtaagtttaacgaaggtcgggaccagtcgagtcagtgagagtgactcgaggaactagtcttacncctctacactntacgatcgtagtcgtacgactaacgtagtaattacgttacactaacttactactagtaacaaagtactaacttacctaccgtacccgttacgtacgttcggacggtacggacagtcgtagatacttaacgaacgtagttgttcgactcgctaacgtctcgttctccttctcc

SEQ ID NO: 357860 - DNA, 643 bp, Homo sapiens
  misc_feature: GZ8MTXP01EV5WU.17.44.D11.1.454.CMB.2.raw
  modified_base (190)..(190): a, c, t, g, unknown or other
  misc_feature (190)..(190): n is a, c, g, or t
  modified_base (277)..(277): a, c, t, g, unknown or other
  misc_feature (277)..(277): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctatagganacagagtcaccatcacttggccgggcaagtcagagcaattaacagattatagtaaattggtatacagacaagaaaccgagggaaacncccctaagttcctgatctatgctagacatcctaagtttaacgaaaggttcgggtacccagtcggaggttcaggtggacagtggatcgtagggaactagtatttcacttcacactatcgagctagtgtcgactaaaccgtagtaaagttatttacgacttaaaccttaacttactacggtaacaaagtaaacgtaaactttaaccaaaccttacccccgttaccgttaaccgttttcggacccggtaaacggggaccctaaaggtccggttaagggaagtaaaccgttaaacgaaaacccggtaagttcgggttcgttacgtaacgtaccaacctacgttcgttacgttcctttaaccgttaacccg

SEQ ID NO: 357861 - DNA, 540 bp, Homo sapiens
  misc_feature: GZ8MTXP01BACHF.17.44.D11.1.454.CMB.2.raw
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
  modified_base (424)..(424): a, c, t, g, unknown or other
  misc_feature (424)..(424): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatgtaaattggtatcagcaagaaaccgagggaaagacccctaaagttcctagatctatgctgcatccagtttacaaagtgggccatcgaggttcagtggnagtgatcngggcagatttccactctcaccatcagcagtgtgactaacctgaaagtattttagctaaacttacgtaactggtacaaacanaaactttacaaacttacccctaccgtactttcggccctaacggggacctaaggctagggacgaattacgaaacgtaacgttgcggctcgcaaccctatccttgttccttcgtaacc

SEQ ID NO: 357862 - DNA, 756 bp, Homo sapiens
  misc_feature: GZ8MTXP01C4SU4.17.44.D11.1.454.CMB.2.raw
  modified_base (167)..(167): a, c, t, g, unknown or other
  misc_feature (167)..(167): n is a, c, g, or t
  modified_base (220)..(220): a, c, t, g, unknown or other
  misc_feature (220)..(220): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgaccctagtttcccnctccctgtctgcgtctataggagacagagtccaactatccacgttggccgganaaagtcagagactaattaacagtatagtagtaacttggatcagcaagaaacgaggaaactcccctaaagtcctagacttacgtatcggactcgactacgtaccgtaaggttttaacgaaagggtccggggtaccagttaccggtaggttacctagggtcggactagggttacgacgttacggttacgggaactaagtactttcaaccttcacgacactacgagtacgtaaggtgtacggtaacctaaccgttagtaaacggttacgttttacgaaacgttaaaccgtttactaaacccgttaacggggttaaacaaaaccggtaaactttaaacccgtttaaaccgtaaaacccctttacccccgtttaaccggtttaaaccggttttaccggggaaacccgggttaacgggggtaaacccaagggtaaacccgttaggggaacttaaacgaacccgtaaaacggttcgttacgggttcgttaaccggtcgaaccctccggtaacgttccgttaacgtcctttaacgttaaccccg

SEQ ID NO: 357863 - DNA, 497 bp, Homo sapiens
  misc_feature: GZ8MTXP02JHACR.17.44.D11.1.454.CMB.2.raw
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatgtaaattggtatcagcaagaaaccaggaaacgcccctaaagtcctgatctatgctgcatccagtttacaaagtgggccatcgagttcagtgcagtggatcgtgggacagtatttcactctacaccatcagcagtgtgcaactgaagtatttagactaacttactactgtacaacagaattacaactacccctcgtactttcgacctaggggacaagtcgtagagactacaaacgaactgtgctgcacatctcgtctctac

SEQ ID NO: 357864 - DNA, 532 bp, Homo sapiens
  misc_feature: GZ8MTXP02IWGZN.17.44.D11.1.454.CMB.2.raw
tcagcgtagactagcacgaccggtgctcgatttagcgcagtacgaaggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatgtaaattggtatcagcagaaaccagggaaagcccctaaagttcctgatctatgctgcatccagtttacaaagtgggtccatcgagttcagtgcagtggatcgtgggacagatttcatctcaccatcagcagtgtgcaacctgaagattttagacaacttactaacttagtactaacaataacttaactaactaccctacgttactttacggaccgtacgggacaacgtacgtaggacgaactaacgaaacgtaacgtacgtacgacgtaacgacactactactacgtacttactac

SEQ ID NO: 357865 - DNA, 526 bp, Homo sapiens
  misc_feature: GZ8MTXP02HO32W.17.44.D11.1.454.CMB.2.raw
  modified_base (267)..(267): a, c, t, g, unknown or other
  misc_feature (267)..(267): n is a, c, g, or t
  modified_base (380)..(380): a, c, t, g, unknown or other
  misc_feature (380)..(380): n is a, c, g, or t
  modified_base (479)..(479): a, c, t, g, unknown or other
  misc_feature (479)..(479): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccggcaagtcagagcattaacagatatgtaaatggtatcagcaagaaaccagggaacncccctaagttcctgatctatgctgcatcctagtttaacaaaggtcgggtacccagtcgaggttcaggtggcagtggatcgtagggactagtactttcacttctacactatcancagtgtgacaactgaagtatttgactaacttactactagtacaacataacttaacaactaccctacgtactttcggaccgtacgggacagtcgtagganactacgaaacgacgtagtggactcgacactactctcgtctttactac

SEQ ID NO: 357866 - DNA, 531 bp, Homo sapiens
  misc_feature: GZ8MTXP02HRDF4.17.44.D11.1.454.CMB.2.raw
  modified_base (418)..(418): a, c, t, g, unknown or other
  misc_feature (418)..(418): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccggcaagtcagagcattaacagatatgtaaatggtatcagcaagaaaccaggaaagcccctaaagtcctgatctatgctgcatccagtttacaaagtggggtcccatcgaggttcagtggcagtgatcgtgggacagtatttcactctcaaccatcagcagtgtgcaaacctgaagtatttagactaaacttactactgtactaaaanaataactaactaacctaccctacgtacgttcggaccgtacgggaacaagtacgtaggaagaactaacgaaacgtaacgtacgtacgacgtcgacactactactctcttactac

SEQ ID NO: 357867 - DNA, 508 bp, Homo sapiens
  misc_feature: GZ8MTXP02I7AV0.17.44.D11.1.454.CMB.2.raw
  modified_base (268)..(268): a, c, t, g, unknown or other
  misc_feature (268)..(268): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccggcaagtcagagcattaacagatatgtaaattggtatcagcaagaaaccagggaaancccctaaagttcctgatctatgctgcatccagtttacaaagtgggtcccatcgaggttcagtgcagtggatctgggcagatttcactctcaccatcagcagtgtgcaaacctgaaagtattttgactaacttactactgtacaacagtaattaacaactacccctcgtactttggcctaggggaccaagctaggagactacaaaacgactacgtggctcgacaccatctcgttcttctac

SEQ ID NO: 357868 - DNA, 494 bp, Homo sapiens
  misc_feature: GZ8MTXP02F4OEU.17.44.D11.1.454.CMB.2.raw
  modified_base (264)..(264): a, c, t, g, unknown or other
  misc_feature (264)..(264): n is a, c, g, or t
tcagcgtagactagcacgaccggtgctcgatttagcgcagtacgaaggggagtcagtctcagtcaggacacagcatggacatgagggtcccgctcagctcctggggctcctgctactctggctccgaggtgccagatgtgacatccagatgacccagtttccctcctccctgtctgcgtctataggagacagagtcaccatcacttgccgggcaagtcagagcattaacagatatagtaaattggtatcagcagaacaggaaancccctaagtcctgatctatgctgcatccagtttacaaagtggggtccagtcgaggttcagtgcagtgatcgtgggcagtattcactctcaccatcagcagtgtgacaacgtgaagtatttgactaacttactactgtacaatagtaaacttacaactaccctacgtactttcggaccagggacagctaggagactacgaaacgacgtgtcggctgcacatctgtctctac

SEQ ID NO: 357869 - DNA, 564 bp, Homo sapiens
  misc_feature: GZ8MTXP02HSWDJ.17.44.D11.1.454.CMB.2.raw
  modified_base (214)..(214): a, c, t, g, unknown or other
  misc_feature (214)..(214): n is a, c, g, or t
  modified_base (268)..(268): a, c, t, g, unknown or other
  misc_feature (268)..(268): n is a, c, g, or t
  modified_base (347)..(347): a, c, t, g, unknown or other
  misc_feature (347)..(347): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccggnaagtcagagcattaacagatatgtaaattggtatcagcaagaaaccaggaaacncccctaagttcctgatctatgctgctatcctagtttacaaaggtcggggtacccatcgaggttcagtgcagtggatcgngggctagatttcactctcacctatcagcagtgtgacctaaactgtaacgtatttcgactaacttacttactagttacaaactagtaacttacctaaactacccctacgtacgtttcggaccgtaaggggaccaaggtccgtagggaacaacttacgaaaacgtacgttaggtcggtactaacggacctaaccgtactcctttcgtcctttactaccg

SEQ ID NO: 357870 - DNA, 554 bp, Homo sapiens
  misc_feature: GZ8MTXP02HC9LM.17.44.D11.1.454.CMB.2.raw
  modified_base (272)..(272): a, c, t, g, unknown or other
  misc_feature (272)..(272): n is a, c, g, or t
  modified_base (435)..(435): a, c, t, g, unknown or other
  misc_feature (435)..(435): n is a, c, g, or t
  modified_base (501)..(501): a, c, t, g, unknown or other
  misc_feature (501)..(501): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgaccctagtttccctcctccctgtctgcgtctataggagacagagtcaccatcacttgccggcaagtcagagcattaacagatatagtaaattggtatcagacaagaaaccgagggaacncccctaagtcctagatctatgctgcatcctaagtttaacaaaggtcgggtacccagtcgaggttcaggtgcagtggatcgtagggacagtatttcactctacaccatcagcagtgtacgactaactgaagttatttacgactaacttactactagtactaaanagtaacttaaccaaaccgttacccctacgtactttcggaccgtaaggggaccaaggactagggaanaactacgaaaacgacgtagtcgactaacgactacctatctcgtacttactacc

SEQ ID NO: 357871 - DNA, 535 bp, Homo sapiens
  misc_feature: GZ8MTXP02IPFJE.17.44.D11.1.454.CMB.2.raw
  modified_base (338)..(338): a, c, t, g, unknown or other
  misc_feature (338)..(338): n is a, c, g, or t
  modified_base (374)..(374): a, c, t, g, unknown or other
  misc_feature (374)..(374): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatgtaaatggtatcagcaagaaaccaggaaacgcccctaagtcctgatctatgctgcatccagtttacaaagtgggtccatcgagttcagtgcagtggatcgngggacagtatttcactctacacctatcagcagtgtnaccaacgtgaagtattttcgactaactttactactacgtacaaacaagtaacttaacaaacttacccctacgtacgtttcggaccaacggggaccaagtccgtaggaagactaacgaaaacgtacgtgtaggctaagacctacactcgtcgtcttacaccg

SEQ ID NO: 357872 - DNA, 555 bp, Homo sapiens
  misc_feature: GZ8MTXP02JZGXF.17.44.D11.1.454.CMB.2.raw
  modified_base (270)..(270): a, c, t, g, unknown or other
  misc_feature (270)..(270): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatgtaaattggtatcagcaagaaaccagggaaacncccctaaagttcctgatctatgctgcatccagtttacaaaggtcgggtccatcgaggttcaggtgctagtggatcgtagggacagtatttccactctacaccatcagcagtgtcgacaacgtgaaagtatttagactaacttactactagtacaactaagtaacttaactaaacttaccccgtaccgttacgtttacggaccgtacggggtaaccaacgtacgtaggagactaacgaaacgtacgtacgtacggactcgaccactacgtctacgttacttctacc

SEQ ID NO: 357873 - DNA, 512 bp, Homo sapiens
  misc_feature: GZ8MTXP02IKTB7.17.44.D11.1.454.CMB.2.raw
  modified_base (414)..(414): a, c, t, g, unknown or other
  misc_feature (414)..(414): n is a, c, g, or t
  modified_base (462)..(462): a, c, t, g, unknown or other
  misc_feature (462)..(462): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatagtaaatggtatcagacaagaaaccaggaaacgcccctaagtcctgatctatgctgcatccagtttacaaaggtgggtaccagtcgagtcagtgcagtgatcgtgggcagtattcactctcacctatcagcagtgtgactaactagtaagtatttgactaacttactactgtacaanataattaacaactaccctacgtacgtttcgacgtaggacagcgtaganactaacaaacgtactagtagcgtaagacactactactcgtacttactacc

SEQ ID NO: 357874 - DNA, 525 bp, Homo sapiens
  misc_feature: GZ8MTXP02I29TU.17.44.D11.1.454.CMB.2.raw
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatgtaaattggtatcagcaagaaaccagggaaacgcccctaaagttcctagatctatgctgcatccagtttacaaagtgggtaccatcgagttcagtgcagtggatcgtgggacagtatttcactctacaccatcagcagtgtgacaactgaagtatttagactaacttactactgtacaacagtaattacaactaccctacgtactttcggaccgtaggggaccaagtacgtaggaagtactacgaaaacgtactagtacggactaagcaacactctcgttacttctac

SEQ ID NO: 357875 - DNA, 519 bp, Homo sapiens
  misc_feature: GZ8MTXP02F883R.17.44.D11.1.454.CMB.2.raw
  modified_base (190)..(190): a, c, t, g, unknown or other
  misc_feature (190)..(190): n is a, c, g, or t
  modified_base (268)..(268): a, c, t, g, unknown or other
  misc_feature (268)..(268): n is a, c, g, or t
  modified_base (367)..(367): a, c, t, g, unknown or other
  misc_feature (367)..(367): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctatagganacagatcaccatcacttgccggcaagtcagagcattaacagatatgtaaattggtatcagcaagaaaccagggaaacncccctaagttcctagatctatgctgcatccagtttacaaaggtcgggtccagtcgagttcagtgcagtgatcgtgggcagtatttcactctcaccatcngcagtgtgacaactgaagtatttgactaacttactactgtacaacataaatacaacctacccctacgtactttcggaccgtaggggaaccaaggccgtaggagtaactacgaaacgtaacgtgtggtactgacactactctcgtactctacc

SEQ ID NO: 357876 - DNA, 575 bp, Homo sapiens
  misc_feature: GZ8MTXP02GX20S.17.44.D11.1.454.CMB.2.raw
  modified_base (215)..(215): a, c, t, g, unknown or other
  misc_feature (215)..(215): n is a, c, g, or t
  modified_base (271)..(271): a, c, t, g, unknown or other
  misc_feature (271)..(271): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggnaagtcagagcaattaacagatatgtaaattggtatcagcaagaaaccagggaaacncccctaagttccagatctatgctgcatccagtttacaaagtgggtcccatcgagttcagtgcagtggatcgtgggcagtatttcactctcaccatcagcagtgtgactaactgaagtatttagactaactttaactactagtacaaactagtaacttaacaactaccccgtacgtacgttttacggacccgtaggggaacccaaggtaccgtaggtacgtaacgtaaccgaaaacggtaacgttacggtacggtacgttaacggacctaaccgtacttaccttcggtttaccttactttacccg

SEQ ID NO: 357877 - DNA, 550 bp, Homo sapiens
  misc_feature: GZ8MTXP02G48DA.17.44.D11.1.454.CMB.2.raw
  modified_base (415)..(415): a, c, t, g, unknown or other
  misc_feature (415)..(415): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccggcaagtcagagcaattaacagatatgtaaattggtatcagcagaaaccagggaaacgcccctaagttcctgatctatgctgcatccagtttacaaagtgggtcccatcgaggttcacgtgcagtggatcgtgggcagatttcactctcaccatcagcagtgtagcaactgaagtatttagactaacttactacttagtacaanagtaattaacaactacccctcgtaactttcggaccgtaacggggaccaaggtcctagggacgtaacgtaccaaaacggtaacgtcgtacggtcgtaacgacccaacgtacttctacggtttaccttcgtaacccg

SEQ ID NO: 357878 - DNA, 529 bp, Homo sapiens
  misc_feature: GZ8MTXP02GZET6.17.44.D11.1.454.CMB.2.raw
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (347)..(347): a, c, t, g, unknown or other
  misc_feature (347)..(347): n is a, c, g, or t
  modified_base (479)..(479): a, c, t, g, unknown or other
  misc_feature (479)..(479): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcaattaacagatatagtaaattggtatcagcaagaaaccaggaaacncccctaagttccngatctatgctgcatcctaagtttacaaaggtcgggtcccagtcgagttcagtgcagtgatcgngggcagtatttcactctcacctatcagcagtgtgactaactgaagttatttagactaactttactactagtacaacagtaacttacaacctaccctcgtacgtttcggaccgtagggaccaaggtctagganactacgaaacgtacgtgtacggactcgacactactctacgtcttactacc

SEQ ID NO: 357879 - DNA, 599 bp, Homo sapiens
  misc_feature: GZ8MTXP02HLI0W.17.44.D11.1.454.CMB.2.raw
  modified_base (166)..(166): a, c, t, g, unknown or other
  misc_feature (166)..(166): n is a, c, g, or t
  modified_base (284)..(284): a, c, t, g, unknown or other
  misc_feature (284)..(284): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttcccncctccctgtctgcgtctataggagacagagtcaccatcacttgccgggcaagtcagagcattaacagatatgtaaattggtatcagacaagaaaccgaggaaacgcccctaagttccngatctatgctgcatccagtttacaaggtcgggtccagtcgaggttcagtggcagtggatcgtaggggactagtatttcactctacacctatcagctagtgtagcaactagaagtatttgactaaacttactacttagtacaaactaataaattaacctaaactacccctaccgtacgttttacggaccgtaacgggggaaccaacggtacgtacgggtaaggaaactaacgaaaaaccggtaacgttaacgttacgggaccttaacggaaccaacccgttaaagtaccgtttacgttcctttaaccgtttacccg

SEQ ID NO: 357880 - DNA, 540 bp, Homo sapiens
  misc_feature: GZ8MTXP02HZ03K.17.44.D11.1.454.CMB.2.raw
  modified_base (270)..(270): a, c, t, g, unknown or other
  misc_feature (270)..(270): n is a, c, g, or t
  modified_base (425)..(425): a, c, t, g, unknown or other
  misc_feature (425)..(425): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatgtaaattggtatcagcaagaaaccaagggaacncccctaaagttcctagatctatgctgcatccaagtttaacaaaggtcggggtacccagtccggaggttcagtggcaggtggatcgtgggcagtatttcacttctcacatcagcagtgtagactaacctgaagttatttgactaacttactacgtntacaaatagtaacttacaacttacccctacgttacgtttcggaccgaggggaccaaggtctagggacaactacgaaacgtactggtcgactgacactactcgtctacctttcacc

SEQ ID NO: 357881 - DNA, 575 bp, Homo sapiens
  misc_feature: GZ8MTXP02GI7T4.17.44.D11.1.454.CMB.2.raw
  modified_base (270)..(270): a, c, t, g, unknown or other
  misc_feature (270)..(270): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatgtaaattggtatcagcaagaaaccagggaaacncccctaaagttcctagatctatgctgcatcctagtttaacaaaggtgggtcccatcgagttcagtgcagtggatcgtgggacagtatttcactctacaccatcagcagtgtgactaactgtaagtattttgactaaactttactactagtacaacaagtaaacttaacaaaccttacccccttaccgttaccgttttacgggaccccgtaaagggggaccctaaaggacgttacgggaagaactaacaaaacggtaacgttacggtggtacctaacgaccaccctattctacgttccttactacc

SEQ ID NO: 357882 - DNA, 530 bp, Homo sapiens
  misc_feature: GZ8MTXP02JOFJ0.17.44.D11.1.454.CMB.2.raw
  modified_base (270)..(270): a, c, t, g, unknown or other
  misc_feature (270)..(270): n is a, c, g, or t
  modified_base (381)..(381): a, c, t, g, unknown or other
  misc_feature (381)..(381): n is a, c, g, or t
  modified_base (393)..(393): a, c, t, g, unknown or other
  misc_feature (393)..(393): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatgtaaattggtatcagcaagaaaccagggaaacncccctaaagttcctgatctatgctgcatccagtttacaaaggtcgggtcccagtcgaggttcagtggcagtggatcgtgggacagtatttcactctcaccatcagcagtgngacactgaagtntttagactaactttactactagtacaacaagtaacttaacaaccttacccctacgtacgtttacggacccgtaggggaccaagacgtaggagactacgaaacgtacgtggagctgaccactactctcgtacttctac

SEQ ID NO: 357883 - DNA, 556 bp, Homo sapiens
  misc_feature: GZ8MTXP02HIV5B.17.44.D11.1.454.CMB.2.raw
  modified_base (190)..(190): a, c, t, g, unknown or other
  misc_feature (190)..(190): n is a, c, g, or t
  modified_base (272)..(272): a, c, t, g, unknown or other
  misc_feature (272)..(272): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctatagganacagagtcaccatcacttggccgggcaagtcagagcaattaacagatatagtaaattggtatcagcaagaaaccagggaacncccctaagttcctgatctatgctgcatccagtttacaaaggtcgggtccatcgagtcagtgcagtgatcgtgggactagtatttcactcctcaacctatcagcagtgtacgacactagaatatttagactaacttatacttagtactaactagtaacttaacaaacctaccccttacgtacgtttacggaccgtaacggggacaacggtcgtaggacgtaactaacgaaaacgtaacgtaggtacgtacgtaacgacacctacttcgttacttaccttctaacc

SEQ ID NO: 357884 - DNA, 552 bp, Homo sapiens
  misc_feature: GZ8MTXP02I9ZD1.17.44.D11.1.454.CMB.2.raw
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (356)..(356): a, c, t, g, unknown or other
  misc_feature (356)..(356): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgaccctagtttccctcctccctgtctgcgtctataggagacagagtcaccatcacttgccggcaagtcagagcattaacagatatgtaaattggtatcagacaagaaaccagggaaacncccctaagttccngatctatgctgcatcctaagtttacaaaggtcgggtaccagtcgaggttcaggtgcagtggatcgtgggacngtattcactctcacatacagcagtgtgacctaactgaagtatttagactaacttactactagtaacaataagtaactaactaacctacccctacgtacgtttcggaccgtaaggggacccaagtaccgtaggaacgactaaacgaaacgtaacgtacgtacgacgtcgaccactactcgtacgttaccttactacc

SEQ ID NO: 357885 - DNA, 541 bp, Homo sapiens
  misc_feature: GZ8MTXP02G6AR0.17.44.D11.1.454.CMB.2.raw
  modified_base (277)..(277): a, c, t, g, unknown or other
  misc_feature (277)..(277): n is a, c, g, or t
  modified_base (356)..(356): a, c, t, g, unknown or other
  misc_feature (356)..(356): n is a, c, g, or t
  modified_base (390)..(390): a, c, t, g, unknown or other
  misc_feature (390)..(390): n is a, c, g, or t
  modified_base (423)..(423): a, c, t, g, unknown or other
  misc_feature (423)..(423): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcaattaacagatatagtaaaattggtatcagacaagaaacccgaagggaaacncccctaaagttcctagatctatgctgcatccagtttaacaaaggtcgggtccagtcgaggttcagtggcagtggatcgngggactagtatttcactctcaccatcagcagtgngacaacagaagtatttgactaacttactacgtntacaaactataacttaacaaaccttaccctacgtactttcggaccgaggggaccaagctaggaagactacgaaaacgtacgtgtacggctaacgacaacctatctactccttactacc

SEQ ID NO: 357886 - DNA, 491 bp, Homo sapiens
  misc_feature: GZ8MTXP02JQC9L.17.44.D11.1.454.CMB.2.raw
  modified_base (269)..(269): a, c, t, g, unknown or other
  misc_feature (269)..(269): n is a, c, g, or t
  modified_base (338)..(338): a, c, t, g, unknown or other
  misc_feature (338)..(338): n is a, c, g, or t
  modified_base (409)..(409): a, c, t, g, unknown or other
  misc_feature (409)..(409): n is a, c, g, or t
  modified_base (473)..(473): a, c, t, g, unknown or other
  misc_feature (473)..(473): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatgtaaattggtatcagcagaaaccagggaaacncccctaagtcctgatctatgctgcatccagtttacaaagtgggtccatcgagttcagtgcagtgatcgngggcagatttcattctcaccatcagcagtgtgcaacctgaagtatttgactaacttactactgtacaacanaattacaataccctcgtactttgccaggggaccaagctagagactacgaaacgaactgtaggcngcaccatctcgtctctac

SEQ ID NO: 357887 - DNA, 513 bp, Homo sapiens
  misc_feature: GZ8MTXP02GE9T0.17.44.D11.1.454.CMB.2.raw
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccggcaagtcagagcattacagatatgtaaatggtatcagcaagaaaccagggaaagcccctaaagttcctagatctatgctgcatccagtttacaaagtgggtccatcgagttcagtgcagtgatcgtgggacagatttcactctacaccatcagcagtgtagacaaacctgaaagtattttgactaaacttactactagtacaaacagtaaattacaaactacccctacgtactttcggacctaggggaccaagtctaggagactacgaaaacgactgcggactgcacactctctctactac

SEQ ID NO: 357888 - DNA, 605 bp, Homo sapiens
  misc_feature: GZ8MTXP02I0H7E.17.44.D11.1.454.CMB.2.raw
  modified_base (275)..(275): a, c, t, g, unknown or other
  misc_feature (275)..(275): n is a, c, g, or t
  modified_base (399)..(399): a, c, t, g, unknown or other
  misc_feature (399)..(399): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatcgaccctagtttccctcctccctgtctgcgtctataggagacagatcaccatcacttggccgggcaagtcagagcaattaacagatatagttaaattggatcagacaagaaaccagggaaacncccctaaagttccagatctatgctgactatccgtaagtttaaacgaaaggttcggggtaccctagtccggtaaggttcaggttggacagtggatcgtgggactagtactttcactctacaaccntcagctagtgtcgactaacgtgtaaattatttcgactaaactttactaacttgtaacaaactaagtaaacttaaacctaacccttaccccgttacgttaccgtttacgggacccggtaacggggtaaccaagtccgtaggaaacgtactaaacgaaacgtacgtacggtacgtctaacgctaactactcttacgtccttactaccg

SEQ ID NO: 357889 - DNA, 625 bp, Homo sapiens
  misc_feature: GZ8MTXP02H1KEY.17.44.D11.1.454.CMB.2.raw
  modified_base (190)..(190): a, c, t, g, unknown or other
  misc_feature (190)..(190): n is a, c, g, or t
  modified_base (281)..(281): a, c, t, g, unknown or other
  misc_feature (281)..(281): n is a, c, g, or t
  modified_base (383)..(383): a, c, t, g, unknown or other
  misc_feature (383)..(383): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctatagganacagagtcaccatcacttggccggacaagtcagagcattaacagatatgtaaatggtatcagcaagaaaccgaggaaacccctaaagtccngatctatgctgactatacctaagtttaacaaaggtcgggtaccaagtcggagttcaggtggactaggtgactcgtagggactagtacttcactctccaactntacagcagtcgtagctaaacttagaaagttatttacgacttaaacttaccttaactacggttaactaaaactaacgtaaacttaaccctaaacttaaccccccgtacgtttaaccgttttcgggacccgtaacggggtaaccaaaacggtcgttaacgggaacgtaacaaaccgttaaaacgaaccgttgtaccgggtacttaacgcccgaaacttactaccttacgttcctttactacccg

SEQ ID NO: 357890 - DNA, 528 bp, Homo sapiens
  misc_feature: GZ8MTXP02F6JMC.17.44.D11.1.454.CMB.2.raw
  modified_base (271)..(271): a, c, t, g, unknown or other
  misc_feature (271)..(271): n is a, c, g, or t
  modified_base (368)..(368): a, c, t, g, unknown or other
  misc_feature (368)..(368): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatagtaaattggtatcagcaagaaaccagggaaacncccctaagtcctagatctatgctgcatccagtttacaaaggtggggtcccagtcgaggttcagtgcagtggatcgtgggcagtattcactctacacntcagcagtgtgacaactgaagtatttcgactaacttactaactagtacaactagtaacttaactaaactacccctacgtacgtttcggacctaaggggaccaagtacgtaggagtactacgaaacgacgtagtggctgacactactcgtcgtactactac

SEQ ID NO: 357891 - DNA, 564 bp, Homo sapiens
  misc_feature: GZ8MTXP02G8TMY.17.44.D11.1.454.CMB.2.raw
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatgtaaatggtatcagcaagaaaccagggaaacgcccctaagttcctagatctatgctgcataccagtttaacaaaggtcggggtcccagtcggaggttcagtggcagtggatcgtgggacagtattcactctacacatcagcagtgtgacaactgaatatttgactaacttactactagtacaacacgtaaattaaccaaccttacccctacgttaacgtttcggaccgtaacggggaaccaacggtacgtaggacgtaactaaccgaaaacggtaacgttggtacggtctaacggacctaccgtacttcgtacgttcttacctaccg

SEQ ID NO: 357892 - DNA, 539 bp, Homo sapiens
  misc_feature: GZ8MTXP02JUMH3.17.44.D11.1.454.CMB.2.raw
  modified_base (276)..(276): a, c, t, g, unknown or other
  misc_feature (276)..(276): n is a, c, g, or t
  modified_base (496)..(496): a, c, t, g, unknown or other
  misc_feature (496)..(496): n is a, c, g, or t
  modified_base (517)..(517): a, c, t, g, unknown or other
  misc_feature (517)..(517): n is a, c, g, or t
  modified_base (527)..(527): a, c, t, g, unknown or other
  misc_feature (527)..(527): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgaccctagtttccctcctccctgtcctgcgtctataggagacagagtcaccatcacttgccgggcaagtcagagcattaacagatatagtaaattcggtatcagacaacgaaaccagggaaacncccctaaagttccagatctatgctgcatccagtttacaaaggtcggtccagtcgagttcagtgcagtggatcgtgggacagtacttcactctcactatcagcagtgtacgactaaccgtgaaagttcgtttacgactaactttacgtactacgtaacaatataaacttacaaaccttacccctagttaaccgtttgacccgtagggacaagtcgtagganactacaaacgtactcgtacgntcgacacctntctcttactctc

SEQ ID NO: 357893 - DNA, 573 bp, Homo sapiens
  misc_feature: GZ8MTXP02G2V64.17.44.D11.1.454.CMB.2.raw
  modified_base (274)..(274): a, c, t, g, unknown or other
  misc_feature (274)..(274): n is a, c, g, or t
  modified_base (421)..(421): a, c, t, g, unknown or other
  misc_feature (421)..(421): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgaccctagtttccctcctccctgtctgcgtctataggagacagagtcaccatcacttggccgggcaagtcagagcaattaacagtatatagtaaattggatcagacaagaaaccgaggaacncccctaagtcctagatctatcgctgcatcctaagtttaacgaaaggttcgggtacccagtcggaggttcaggtgcagtgatcgtagggactagtactttcgacttctacacctatcagctagtcgcacaacgtgtaattacgtttanactaacttactacttagactaaacgtataaacttaacctaacctaccccttacgtacgtttcggaccgtagggaaccaggtacgtaggacgtaactaacgaaaacgtacgtaggtacgactaacgacctactacgttctcttacttctaccg

SEQ ID NO: 357894 - DNA, 550 bp, Homo sapiens
  misc_feature: GZ8MTXP02G76D9.17.44.D11.1.454.CMB.2.raw
  modified_base (166)..(166): a, c, t, g, unknown or other
  misc_feature (166)..(166): n is a, c, g, or t
  modified_base (215)..(215): a, c, t, g, unknown or other
  misc_feature (215)..(215): n is a, c, g, or t
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (339)..(339): a, c, t, g, unknown or other
  misc_feature (339)..(339): n is a, c, g, or t
  modified_base (368)..(368): a, c, t, g, unknown or other
  misc_feature (368)..(368): n is a, c, g, or t
  modified_base (404)..(404): a, c, t, g, unknown or other
  misc_feature (404)..(404): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttcccncctccctgtctgcgtctataggagacagagtcaccatcacttgccgggnaagtcagagcattaacagatatagtaaattggtatcagcaagaaaccgagggaaacncccctaagttccngatctatgctgacatcctaagtttaacgaaaggttcggggtaccccagtacggnggttcaggtggacagtggatcgagggacngtattcactctacactatcagcagtgtcacaacgtnaagtactttgactaactttacatagtcaaagataaacttacaactacccctcgtaacgtttcggaccgacgggacaggtacaggagactaacgaaacgtaacgtgtacggtctaacgaccaacgtactctacgttccttactaccg

SEQ ID NO: 357895 - DNA, 516 bp, Homo sapiens
  misc_feature: GZ8MTXP02I5QUG.17.44.D11.1.454.CMB.2.raw
  modified_base (271)..(271): a, c, t, g, unknown or other
  misc_feature (271)..(271): n is a, c, g, or t
  modified_base (355)..(355): a, c, t, g, unknown or other
  misc_feature (355)..(355): n is a, c, g, or t
  modified_base (373)..(373): a, c, t, g, unknown or other
  misc_feature (373)..(373): n is a, c, g, or t
  modified_base (490)..(490): a, c, t, g, unknown or other
  misc_feature (490)..(490): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatagtaaattggtatcagacagaaaccagggaaacncccctaaagttcctgatctatgctgcatccagtttaacaaaggtcggggtacccatcgaggttcagtgcagtggatctgggacngtatttcactctcacctntcagcagtgtgcaactgaagtatttgactaacttactactgtacaacagaattaacaactacccctacgtacgtttcgccgtaggggaccaagctaggagactacaaacgactacgnggactgaccacactcgtctcttctac

SEQ ID NO: 357896 - DNA, 571 bp, Homo sapiens
  misc_feature: GZ8MTXP02GVYSZ.17.44.D11.1.454.CMB.2.raw
  modified_base (273)..(273): a, c, t, g, unknown or other
  misc_feature (273)..(273): n is a, c, g, or t
  modified_base (286)..(286): a, c, t, g, unknown or other
  misc_feature (286)..(286): n is a, c, g, or t
  modified_base (508)..(508): a, c, t, g, unknown or other
  misc_feature (508)..(508): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcaattaacagatatagtaaattggtatcagcaagaaaccgagggaaacncccctaagttccngatctatgctgcatctaagtttaacaaaggtcgggtaccagtcgagttcagtgcagtgatcgtgggacagtattcactctacaccatcagctagtgtagacctaacgtgtaaagtatttacgacctaaactttactacttagtaacaaacgtaataaacttaaccaaaccttacccccttacgtacgtttcggaccgtaaggggaccaaggtcgtagggaanaactaacgaaaacgtacgtacggtacggctaacgacctaactattccgtcgtttcctactacc

SEQ ID NO: 357897 - DNA, 549 bp, Homo sapiens
  misc_feature: GZ8MTXP02G9NQH.17.44.D11.1.454.CMB.2.raw
  modified_base (226)..(226): a, c, t, g, unknown or other
  misc_feature (226)..(226): n is a, c, g, or t
  modified_base (272)..(272): a, c, t, g, unknown or other
  misc_feature (272)..(272): n is a, c, g, or t
  modified_base (346)..(346): a, c, t, g, unknown or other
  misc_feature (346)..(346): n is a, c, g, or t
  modified_base (398)..(398): a, c, t, g, unknown or other
  misc_feature (398)..(398): n is a, c, g, or t
  modified_base (489)..(489): a, c, t, g, unknown or other
  misc_feature (489)..(489): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgaccctagtttccctcctccctgtcctgcgtctataggagacagagtcaccatcacttgccgggcaagtcagancattaacagatatgtaaattggtatcagcaagaaaccagggaaacncccctaaagttccagatctatgctgcatccatttacgaagtcgggccagtcgagttcaggtgactagtgatcgngggcagtatttcgactctacaccatcagctagtgtcgactaacgtgaagttntttagactaactttactacttgtacaaacgtataacttaaccaacttacccctcgttaacgttggacccgagggtaaccaagtcgtagganacgtaaacgaaacgtacgtggtacgactcgacctaactactccgtcttaccttactaccg

SEQ ID NO: 357898 - DNA, 512 bp, Homo sapiens
  misc_feature: GZ8MTXP02FXVZ1.17.44.D11.1.454.CMB.2.raw
  modified_base (215)..(215): a, c, t, g, unknown or other
  misc_feature (215)..(215): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctataggagacagagtcaccatcacttgccgggnaagtcagagcattaacagatatgtaaattggtatcagacaagaaaccgagggaaacgacccctaagttcctgatctatgctgcatccagtttacaaagtggggtcccatcgaggttcagtgcagtgatcgtgggacagtattcactctacaccatcagcagtgtgcaactcgaagtatttgactaacttactactagtacaacagtaaactacaactaccctacgtacgtttcggaccgtagggaccaagctaggagactacaaacgactcgtacgctcgcacatctagtctactac

SEQ ID NO: 357899 - DNA, 586 bp, Homo sapiens
  misc_feature: GZ8MTXP02HO1W1.17.44.D11.1.454.CMB.2.raw
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
  modified_base (380)..(380): a, c, t, g, unknown or other
  misc_feature (380)..(380): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatcgaccctagtttccctcctccctgtctgcgtctataggagacagagtcaccatcacttggccgggacaagtcagagcaattaacagatatagtaaatggtancagcaagaaccgagggaaacncccctaagttcctagatctatgctgactatcctaagtttaacgaaaggtcgggtaccagtcgaggtcagtgacngtgatcgnggactagtnttcacctctacacntcagctagtgtacgactaacgtagtaagttagtttacactaactttactacgttataacaaacgtagtaacttaaccaaccttacccgtacgttacgtttacggaccgtaacggggtacctaaggtcgtaggtaactaacgtaaacgaaacggtacgtaggtcggacgtaacggacctactactacgttacgttcctttacgtacc

SEQ ID NO: 357900 - DNA, 620 bp, Homo sapiens
  misc_feature: GZ8MTXP02JD9GX.17.44.D11.1.454.CMB.2.raw
  modified_base (190)..(190): a, c, t, g, unknown or other
  misc_feature (190)..(190): n is a, c, g, or t
  modified_base (273)..(273): a, c, t, g, unknown or other
  misc_feature (273)..(273): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttccctcctccctgtctgcgtctatagganacagagtcaccatcacttgccgggcaagtcagagcattaacagatatagtaaattggtatcagacaagaaaccgagggaaacncccctaaagttcctgatctatgctgacatcctaagtttaacaaaggtcgggtacccagtcgaggttcaggtgcagtggatcgtgggactagtactttcacttctacaccatccgagacgagtgtagactaaacctagaacgttattttacgaccttaaactttactacttacgtaacaaacgtaacgtaaactttaaccaaaccttacccccttaccggttacgttttaccgggaaccgtacgggggaaacccaaggtaccgtagggaaataacgtaaaccgaaaacgtaaccgttacgtacgggacctaacggacctaacctatcgtacgtttacctacttaaccg

SEQ ID NO: 357901 - DNA, 542 bp, Homo sapiens
  misc_feature: GZ8MTXP02JL3TD.17.44.D11.1.454.CMB.2.raw
  modified_base (360)..(360): a, c, t, g, unknown or other
  misc_feature (360)..(360): n is a, c, g, or t
  modified_base (384)..(384): a, c, t, g, unknown or other
  misc_feature (384)..(384): n is a, c, g, or t
  modified_base (493)..(493): a, c, t, g, unknown or other
  misc_feature (493)..(493): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatcgaccctagtttccctcctccctgtctgcgtctataggagacagagtcaccatcacttcggccgggcaagtcagagctaattaacagtatatagtaaattggtatcagacaagaaccagggaactcccctaagtcctagatctatcgctgacagtacctagtttaacgaaggttcgggtaccagtcgagttcaggtgctagtgatcgnggacagttacttcactctacactntcgatcgagtgtcgacgtactagtaagttattcgactaacttactactagtacaactagtaacttaactaacctaccctcgtacgttcgacgtacggacagtcgtaganacgtacgaacgtacgtcgtacgcaacgcacgtactctcgtactactacg

SEQ ID NO: 357902 - DNA, 640 bp, Homo sapiens
  misc_feature: GZ8MTXP02JDGPC.17.44.D11.1.454.CMB.2.raw
  modified_base (238)..(238): a, c, t, g, unknown or other
  misc_feature (238)..(238): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatcgaccctagtttcccctcctccctgtcctgcgtctataggagacagatcaccatcacttggccgggcaagtcagagcaattaacanatatagttaaaattggtatcagcaaagaaaccgaagggaactacccctaagtcctagatctatgtctgactactcgtaagtttaacgtaaggtcgggtacccctagttcgtaggttcaggttggacgtaggtgaacttcggtacgggtactacgtttacttttacccaccttccctacaacccgtattacccgagtaccgtagttacgtacgacgtaaaccgttagtaaagtttacgttttacgaccttaacctttaacttacgttacgtacaaacgtaactaacttaaccaccttacccgtacgttacgtttcggacgaacgggacaggtacgaggaatactaaaccgaaacgtacgtacgggtcgacgtcgacctactacgttctcgttacttactaccg

SEQ ID NO: 357903 - DNA, 666 bp, Homo sapiens
  misc_feature: GZ8MTXP02F7DEU.17.44.D11.1.454.CMB.2.raw
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgaccctagtttccctcctccctgtctgcgtctagtaggagacagagtcaccatcacttgccggcaagtcagagcaattaacagatatagtaaattggatcagacaagaaacgaggaaactcccctaagttcctagattctatcgctgacattccctaagtttaacgaaaggttcggggtacccagtacggtaggttcaggtgactagtggatcggtagggtacgtagtactttacacctcgtaccacatacagtacgtagtgacgactaaccgtagtaaacgtttatttacgaaccttaaactttactacttacgttaacaaacgtaaacgtaaacttaaacctaaacccttaacccccgttaccggtttaaccgtttaccgggacccgtaaacgggggaaccctaaaacggtcggttaacgggaacgttaaacgtaaaccgtaaaaccggtaacgttcggtacggtaccaacggtacccaaccgttacttccgttacttcctttaccttaccg

SEQ ID NO: 357904 - DNA, 620 bp, Homo sapiens
  misc_feature: GZ8MTXP02G38ON.17.44.D11.1.454.CMB.2.raw
  modified_base (277)..(277): a, c, t, g, unknown or other
  misc_feature (277)..(277): n is a, c, g, or t
  modified_base (297)..(297): a, c, t, g, unknown or other
  misc_feature (297)..(297): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatcgaccctagtttccctcctccctgtctgcgtctataggagacagagtccaaccatcacttcgccgggacaagtcagagctaattaacagtatatagtaaattgtatcagcaagaaccgaggaacncccctaagtccagatctatnctgcatacgtagtttaacgaaggtcgggtacccagtcggaggttcagtggactaggtggatcggaggactagttacttccgaccttctacaccgtatacgacgacgtacggtcgtacggtaacctaaaccgtagtaaggttactttacgacttaaacttacgtacgtactacgtaaactaagtaaacttaaccctaaccgtaccccgttacgttacgtttaccggaccgtaacggggaccctagtacgtaggacaacgttaacgaaacgtacgtaggtaccgacgttaacgaccgtacgtacttcgtcgtaccttactacccg

SEQ ID NO: 357905 - DNA, 554 bp, Homo sapiens
  misc_feature: GZ8MTXP02ID41F.17.44.D11.1.454.CMB.2.raw
  modified_base (166)..(166): a, c, t, g, unknown or other
  misc_feature (166)..(166): n is a, c, g, or t
  modified_base (214)..(214): a, c, t, g, unknown or other
  misc_feature (214)..(214): n is a, c, g, or t
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtttcccncctccctgtctgcgtctataggagacagagtcaccatcacttgccggnaagtcagagcaattaacagatatagtaaattggatcagcaagaaaccagggaacncccctaagttccngatctatgctgcatccgtaagtttacaaaggtcgggacccatcgaggttcagtggcagtgatcgtgggactagtactttcaacttctacacctatcagctagtgtcgactaaccgtagtaaacgtattttagacctaactttaactacgtactaactaaacaacgtaaatttaacaaaccttaccccgttacgtacgttttacggaccaaggggaaccaagtctaggacataaacgaaacgaactgtacgatcgcacactactctcttctac

SEQ ID NO: 357906 - DNA, 614 bp, Homo sapiens
  misc_feature: GZ8MTXP02JAVVA.17.44.D11.1.454.CMB.2.raw
  modified_base (191)..(191): a, c, t, g, unknown or other
  misc_feature (191)..(191): n is a, c, g, or t
  modified_base (315)..(315): a, c, t, g, unknown or other
  misc_feature (315)..(315): n is a, c, g, or t
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
  modified_base (409)..(409): a, c, t, g, unknown or other
  misc_feature (409)..(409): n is a, c, g, or t
  modified_base (435)..(435): a, c, t, g, unknown or other
  misc_feature (435)..(435): n is a, c, g, or t
  modified_base (537)..(537): a, c, t, g, unknown or other
  misc_feature (537)..(537): n is a, c, g, or t
tcagcgtagactagcacgaccggtgctcgatttagcgcagtacgaagggggagtcagtctcagtcaggacacagcatggacatgagggtccccgctcagctcctggggctcctgctactctggctccgaggtgccagatgtgacatccagatcgaccctagtttccctcctccctgtctgctctatagganacagagtcaccatcacttggccgggtacaagtcagagactaattaacagtatatagtaaattggtaactcgagacaagaaaccgaggggaaacctacccctaagttcctagtactctatgactncctattacctaagtttaacaaggtcgggtacccagtacggtagttcaggtgactaggtgatcgnggactntattacgacctctacactatacgngcagttgacgtaactactagtaagtntttacgacttacttacgtacgtatacaaacgattaaactaacctacctaccccttacgttacggtttacggccgtaacgggacctaaggtacgaggtaaacncgtaaaacctaaacggtcgttaacggtcgtacgtaacgaccccttaattacgtcgttcggttacctactttaacccg

SEQ ID NO: 357907 - DNA, 522 bp, Homo sapiens
  misc_feature: GZ8MTXP01BKSQB.25.32.C10.1.454.CMB.2.raw
  modified_base (205)..(205): a, c, t, g, unknown or other
  misc_feature (205)..(205): n is a, c, g, or t
  modified_base (522)..(522): a, c, t, g, unknown or other
  misc_feature (522)..(522): n is a, c, g, or t
tcagactgtacagtcacgaccggtgctcgatttagtatagacatcaacacacaaaggggcaggaactgctcagttaggacccagacggaaccatggaagccccagcgcagcttctcttcctcctgctactctggctcccagatgccactggagaaattgtgatgacgcagtctccagcctccctgtctgtgtctcctggggaagngccaccctctcctgcagggccagtcagagcgttggcaggacttgcctggtaccagcagaacctggccagcctcccagacctcctcctctatggtcgcctttccaccgacgggccccctggacttactccccgctaggttccaggtggcaggtgggtctggggaacaggtacgtttcactctcaccatcagcagcctgcagtctgagtatttgctagtttattactgtacacctagtataatacgtgcctcgtggtacgtttgcgaagggacaggtagaaagacaaacgacgttgttaggctgcacattcttgttctn

SEQ ID NO: 357908 - DNA, 506 bp, Homo sapiens
  misc_feature: GZ8MTXP01DIIYL.25.32.C10.1.454.CMB.2.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (256)..(256): a, c, t, g, unknown or other
  misc_feature (256)..(256): n is a, c, g, or t
  modified_base (362)..(362): a, c, t, g, unknown or other
  misc_feature (362)..(362): n is a, c, g, or t
  modified_base (490)..(490): a, c, t, g, unknown or other
  misc_feature (490)..(490): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctccgtggggaagngccaccctntcctgcagggccagtcagngcgttgcaggacttgcctggacngcagaactggccagcctccagacctcctcctctatggtcgccttccaccgagggccccctgactactcccccgcaggttcaggtggcaggtcgggtctaggggacnggtagttcactctcaccatcagcagcctgcagtctagaagtatttgctagtttatactggtcactatataatactgcctcgtgtcgttgcaaggaacaaggttgaaagcaaacgacttgttggctgcncatcttgtcttctaac

SEQ ID NO: 357909 - DNA, 566 bp, Homo sapiens
  misc_feature: GZ8MTXP01CGU43.25.32.C10.1.454.CMB.2.raw
  modified_base (216)..(216): a, c, t, g, unknown or other
  misc_feature (216)..(216): n is a, c, g, or t
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
  modified_base (400)..(400): a, c, t, g, unknown or other
  misc_feature (400)..(400): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagacgccaccctntcctgcagggccagtcagagcgttgcaggacttgcctggtaccagcaagaaacctggccagccctcccagacctcctcctctatggtctccttccaccgacgggcccctgactactcccccgctaggttcacggtggctaggtgggtctagggacngtcgttcactcncacatcagcagctgcngtctagtatattgtcgtattattactcgtctacctagtaataataacgtacgtaccgtccgtcggtacggttacggtaccgaacggaaccgtaacggttaaggaaacgaacgaaacgaacgttagttcggacgtggacgaactactacgttcttcgttcgttaacc

SEQ ID NO: 357910 - DNA, 528 bp, Homo sapiens
  misc_feature: GZ8MTXP01EEWCL.25.32.C10.1.454.CMB.2.raw
  modified_base (365)..(365): a, c, t, g, unknown or other
  misc_feature (365)..(365): n is a, c, g, or t
  modified_base (510)..(510): a, c, t, g, unknown or other
  misc_feature (510)..(510): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagagccaccctctcctgcagggccagtcagagcgttggcaggaacttagcctggtaccagcagaaacctggccagcctcccagactcctcctctatggtcgcttccaccacgggccccctgactactcccccgcaggttcagtggcagtgggtctagggacngagttcactctcacatcagcagctgcagtctgtagtatttgtctagtttattactgtctacctataataataaactgtccgtccgtcggtacgttggtcgaacgggaacgaaggttaggaaagacgaaacgaacttagttgcgtncaaccatcttctcttctc

SEQ ID NO: 357911 - DNA, 503 bp, Homo sapiens
  misc_feature: GZ8MTXP01C8NGF.25.32.C10.1.454.CMB.2.raw
  modified_base (360)..(360): a, c, t, g, unknown or other
  misc_feature (360)..(360): n is a, c, g, or t
  modified_base (486)..(486): a, c, t, g, unknown or other
  misc_feature (486)..(486): n is a, c, g, or t
  modified_base (499)..(499): a, c, t, g, unknown or other
  misc_feature (499)..(499): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccatggagaaattgtgatgacgcagtctccagcctccctgtctgtgtctcctggggaagagccaccctctcctgcagggccagtcagagcgttggcaggaacttagcctggtaccagcagaaacctggccagcctcccagactcctcctctatggtcgcttccaccagggccccctgactactccccgcaggttcagtggcagtgggtctgggacngagttcactctcacatcagcagcctgcagtctagtagtatttgctagtttatactggtacactagtataatactgctcgtgtacgttgcaggcaaggttggaaagcgaaacgacttgttgctgacnccatcttgtcttntaac

SEQ ID NO: 357912 - DNA, 553 bp, Homo sapiens
  misc_feature: GZ8MTXP01D8I57.25.32.C10.1.454.CMB.2.raw
  modified_base (208)..(208): a, c, t, g, unknown or other
  misc_feature (208)..(208): n is a, c, g, or t
  modified_base (306)..(306): a, c, t, g, unknown or other
  misc_feature (306)..(306): n is a, c, g, or t
  modified_base (477)..(477): a, c, t, g, unknown or other
  misc_feature (477)..(477): n is a, c, g, or t
  modified_base (510)..(510): a, c, t, g, unknown or other
  misc_feature (510)..(510): n is a, c, g, or t
  modified_base (537)..(537): a, c, t, g, unknown or other
  misc_feature (537)..(537): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagacnccacctctcctgcagggccagtcagagcgttggcaggaacttagcctggtaccagcagaaacctggccagcctcccagacctccctcctctatggtcnccttcccgaccgacgggccccctgactaccgtcccccgcgtaggttccaggtcggcgtagggtcggggtcgtaggggaccaaggtacttcacctctaccaccatcacgcacgcctgacctagttactagtaagtatttgacttagtttatactggtacactagtatatacngctcgtgtcgttgacaggaacaaggttaggaanacgaaagtacttgttgctgcaactctnttcgtccttctaaccg

SEQ ID NO: 357913 - DNA, 522 bp, Homo sapiens
  misc_feature: GZ8MTXP01CVA9B.25.32.C10.1.454.CMB.2.raw
  modified_base (204)..(204): a, c, t, g, unknown or other
  misc_feature (204)..(204): n is a, c, g, or t
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
  modified_base (355)..(355): a, c, t, g, unknown or other
  misc_feature (355)..(355): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctcgtggggaagnccaccctntcctgcagggccagtcagngcgtgcaggactagctggacagcagaactggccagcctccagcctcctcctctatggtcgccttccaccgacgggcccctgactactccccgctaggttcagtggcaggtggggctaggggacngagttcactctcaccatcagcagtcgtggagccgtagaagtattttgacttagtttattacgtgtcgagcagcgtagcgtagttcggccgtcgggtactaggtttcggccgaaggggacagtcgttggagtattacgaaacgactggtgctgcacctaagttcttcg

SEQ ID NO: 357914 - DNA, 561 bp, Homo sapiens
  misc_feature: GZ8MTXP01D04V7.25.32.C10.1.454.CMB.2.raw
  modified_base (305)..(305): a, c, t, g, unknown or other
  misc_feature (305)..(305): n is a, c, g, or t
  modified_base (369)..(369): a, c, t, g, unknown or other
  misc_feature (369)..(369): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctccgtggggaagagcccaccctctcctgcagggccagtcagagcgttggcaggaacttagtctggaccagcagaaacctggccacgcctcccagacctcctcctctatggtcnccttcccaccgacgggccccctgactactccccgctaggttcagtggcaggtgggtctgggacngtagttcactctcaccatcagcagctcgcagtctgtaagtatttgtctagtttattacttcgtactacctaattaataataactacgtccgtccgtcggtacggttacggtaccgaacgggaaccgaagggttaaggaaacgaacgaaacgaacgttacgttgcgtgcaacactcttctcgttcgttaaccg

SEQ ID NO: 357915 - DNA, 631 bp, Homo sapiens
  misc_feature: GZ8MTXP01DDVIT.25.32.C10.1.454.CMB.2.raw
  modified_base (308)..(308): a, c, t, g, unknown or other
  misc_feature (308)..(308): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctccgtggggaagacgccaccctctcctgcagggccagtcagagcgttggcaggacttagctaggaccagcagaaacctggcccagccctcccagaccctccctcctctatcggtcnccttcccaccgacgggtccccctaggaacttacctccccccgctaagggtttccaggttggaccgtagggttcggggtaccgtaggggacctaagtacgtttaccaccttcaccacctaatcccgaagtccaacggccctcgccgtagtacgtagtaagttagtttagtacgttagtttattacgttacgttctaacctagtaataaataacgtcgtccgtccggtcggtacgttacggtacgaacggaaccggaaggttaggaaacgaacgaaacgtaacgttagttcggcgtcgcgaacactcttcttcgttcgttaaccg

SEQ ID NO: 357916 - DNA, 691 bp, Homo sapiens
  misc_feature: GZ8MTXP01D1CJ3.25.32.C10.1.454.CMB.2.raw
  modified_base (306)..(306): a, c, t, g, unknown or other
  misc_feature (306)..(306): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagagccaccctctcctgcagggccagtcagagcgttggcaggaacttagcctggtaccagcaagaaaccgtcggaccacgccctacccagtacctccctcctntagtggtctccttaccaccgacggtccccctagactaccgtcccccgacgtaggttcaggtcggacgtagggtcgggtcgtagggactaaggtctttacaccttctaccactatcacgcacgcctgaccgagttacgtagtaaagttttagttacgtacgtttaagttttaacttacgttacggtaacctaacgttaaagttaaacgttaaacgtacgttccggtacccgttacgggttacgggttaacgggtttaccggaaccgggtaaacggggtaaacggtaaaggggttaaacgggaaacgaaaccggtaaaacggtaacgttacgggttcgttacgtaacgtacctaaccgtacttcgttaccgttaaccttcgtaaccg

SEQ ID NO: 357917 - DNA, 552 bp, Homo sapiens
  misc_feature: GZ8MTXP01BG8L6.25.32.C10.1.454.CMB.2.raw
  modified_base (364)..(364): a, c, t, g, unknown or other
  misc_feature (364)..(364): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctccctgtctgtgtctccgtggggaagagccaccctctcctgcagggccagtcagagcgttgcaggactagcctggaccagcagaaacctggccagccctcccagacctcctcctctatggtgccttcccaccacgggcccctgactactccccgcaggttcagtggcaggtgggtctagggacngagttcactctcacatcagcagcctgcagtctagtaagtatttgctagtttattactggtactacctaagtataaataacgtcggccttcggtgtacgtttggaccgtaaaggggaaccaaagggttagggaaacgacgaaaacgtaacttggttcggctaagctaacatcttacgtccttcgtaacc

SEQ ID NO: 357918 - DNA, 547 bp, Homo sapiens
  misc_feature: GZ8MTXP01AIVTI.25.32.C10.1.454.CMB.2.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaagngccaccctntcctgcagggccagtcagagcgttgcaggactagctggacngcagaacctggccagcctcccagactcctcctctatggtcnccttccaccgagggccccctgactactccccgcaggttcacgtggcagtggtcgtggcgngagtcactctcaccacncacgcacgctcgcgacgtacgtagtagtattgtctagtttattactcgtactactataataactaacgtcgtccgtccgtcggtacgttacggtacgaacggaacgaacggttaaggaaacgaacgaaacgtaacgttacgttcggcgtcgacaacctactcttctcgttcgtc

SEQ ID NO: 357919 - DNA, 517 bp, Homo sapiens
  misc_feature: GZ8MTXP01BQMY8.25.32.C10.1.454.CMB.2.raw
  modified_base (304)..(304): a, c, t, g, unknown or other
  misc_feature (304)..(304): n is a, c, g, or t
  modified_base (364)..(364): a, c, t, g, unknown or other
  misc_feature (364)..(364): n is a, c, g, or t
  modified_base (403)..(403): a, c, t, g, unknown or other
  misc_feature (403)..(403): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagagccaccctctcctgcagggccagtcagagcgttggcaggacttagcctggtaccagcagaaacctggccagccctcccagacctcctcctctatggtnccttccaccagggcccctgactactccccgcaggttcagtggcagtgggtctaggggacnggagtccactctcaccatcagcagctgcagtctgaagtntttgctagtttattactggtcactatataataactggcctacgtgtcgttgccaagggaacaaggttgaaagacgaaacgacttgttggctgcaacctatcttcgtcttcgaac

SEQ ID NO: 357920 - DNA, 554 bp, Homo sapiens
  misc_feature: GZ8MTXP01DQUH6.25.32.C10.1.454.CMB.2.raw
  modified_base (298)..(298): a, c, t, g, unknown or other
  misc_feature (298)..(298): n is a, c, g, or t
  modified_base (366)..(366): a, c, t, g, unknown or other
  misc_feature (366)..(366): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagagccaccctctcctgcagggccagtcagagcgttgcaggaactgcctgtaccagcagaacctggccagcctccagactcctcctctatggtcncttccaccacggggccccctgactacgtcccccgctaggttccaggtggcaggtgggtctaggggacnggagtttccactctaccaccatccagcagcctgctagtctagtaagtattttgctagtttattactggtcctacaagttaataataacgtggtcctacggtggtacgttggaccgtaaggggaaccaagggttagaaacgttacgaaacgacgttgttcgggactgaccaactatcttgttcttctcc

SEQ ID NO: 357921 - DNA, 687 bp, Homo sapiens
  misc_feature: GZ8MTXP01CZO1R.25.32.C10.1.454.CMB.2.raw
  modified_base (308)..(308): a, c, t, g, unknown or other
  misc_feature (308)..(308): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccatggagaaattgtgatgacgcagtctccagcctccctgtctgtgtctccgtggggaagacgccaccctctcctgcgagggccagtcagagcgttggcaggaacttagcctggtaccagcaagaaacctggccagccctcccagacctcctcctctatggtcnccttccaccgacggtccccctgactaccgtcccccgctaggttccaggttcggacgtaggtcgggtcgtaacggggaactggtacgtttccacttcctaccaaccctatacacgcacgtcctcgacgtacgtacgtagtaagttagtttacgttacgttaacgtttaacgtttacgttacggttacgtaacgtaacgttaaacgttaaacgttaaaaccgttaccggttaccggttaaccggttacggtttaccgggtaaccgggtaaccgggtaaccggtaacggtacggttacggtaacgttacgtaacgtaacggttaacggttacgttacggtaacggtacgtaacgtaccgtaccgttacgttccgttcgttcg

SEQ ID NO: 357922 - DNA, 553 bp, Homo sapiens
  misc_feature: GZ8MTXP01EAASQ.25.32.C10.1.454.CMB.2.raw
  modified_base (265)..(265): a, c, t, g, unknown or other
  misc_feature (265)..(265): n is a, c, g, or t
  modified_base (297)..(297): a, c, t, g, unknown or other
  misc_feature (297)..(297): n is a, c, g, or t
  modified_base (364)..(364): a, c, t, g, unknown or other
  misc_feature (364)..(364): n is a, c, g, or t
  modified_base (407)..(407): a, c, t, g, unknown or other
  misc_feature (407)..(407): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaaggagcccaccctctcctgcagggccagtcagagcgttgcaggacttgctgacagcagaacnggcagccctccagacctcctcctctatggtcnccttccaccgacgggccccctgactactccccgcaggttcacgtggcgaggtcgggtctaggggacnggacgttcaccgtctcaccatcagcagcctgcagtctagagtntttgctagtttatactggtcactagtataatactcgtctcgtgtacgtttggaccgaagggaacctaagggttaggaaacgttcgaaaacggtaacgttggttcggacgttcggacaaccgtatcgttagttcccttcgttaaccg

SEQ ID NO: 357923 - DNA, 541 bp, Homo sapiens
  misc_feature: GZ8MTXP01A120O.25.32.C10.1.454.CMB.2.raw
  modified_base (234)..(234): a, c, t, g, unknown or other
  misc_feature (234)..(234): n is a, c, g, or t
  modified_base (371)..(371): a, c, t, g, unknown or other
  misc_feature (371)..(371): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagagccaccctctcctgcagggccagtcagngcgttggcaggaacttagcctggtaccagcagaaacctggccagccctccagactccctcctctatggtcgccttccaccacggggcccctgactactcccccgcaggttcaggtggcaggtggggtctaggggacnggtacgttcactctacaccatcagcacgcctgcagtctagtaagtatttgctagtttatactgtacactagtataatacgtcgcctcgtgtcgtttggaccgaagggaacctaaggttacggaaagcgaaacgacttggttgggctggcaacgatcttcgtcttcgtaac

SEQ ID NO: 357924 - DNA, 638 bp, Homo sapiens
  misc_feature: GZ8MTXP01C5ZDX.25.32.C10.1.454.CMB.2.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctccgtggggaagcgccaccctctcctgcagggccagtcaggagcgttgcaggtacttgcctggaccagcaagaacctggcccagccctcccagacctccctctctagtggtctccttaccgaccgacgggtcccctagactacctcccccgctaggttcaggtcggacgtaggtggggtctaaggggactaaggtacttccaacttccacacccatccacgacacgtccgtgactagttcgtaggtaagttgtttacgacttaagttttacttacgttcgtaccgtaaactaagttaaacttaaacgttaaccgtcggtacccgttcggtaggttaccggttacggaacccggtaaaggaaccgtaaagggttaggaaaccgacgtaaaacgaccgttagggttcgacctcgactaaccgtaactcgttacttccgttctaacccg

SEQ ID NO: 357925 - DNA, 516 bp, Homo sapiens
  misc_feature: GZ8MTXP01BD631.25.32.C10.1.454.CMB.2.raw
  modified_base (206)..(206): a, c, t, g, unknown or other
  misc_feature (206)..(206): n is a, c, g, or t
  modified_base (370)..(370): a, c, t, g, unknown or other
  misc_feature (370)..(370): n is a, c, g, or t
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (509)..(509): a, c, t, g, unknown or other
  misc_feature (509)..(509): n is a, c, g, or t
  modified_base (516)..(516): a, c, t, g, unknown or other
  misc_feature (516)..(516): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctccctgtctgtgtctcctggggaagngccaccctctcctgcagggccagtcagagcgttggcagggaacttagcctggtaccagcagaaacctggccagcctcccagacctcctcctctatggtgccttccaccacgggccccctgactactcccccgcaggttcacggtggcaggtgggtctggggacnggtagttcactctcaccatcagcagcctgcagtctagaagtatttgctagtttatactggtcactagtataatacgtgcctcgtgtcgttgaccaaggaacaggttgaaagcgaaagacttgnggttcngcncntcttntcttctn

SEQ ID NO: 357926 - DNA, 629 bp, Homo sapiens
  misc_feature: GZ8MTXP01B9GJM.25.32.C10.1.454.CMB.2.raw
  modified_base (308)..(308): a, c, t, g, unknown or other
  misc_feature (308)..(308): n is a, c, g, or t
  modified_base (374)..(374): a, c, t, g, unknown or other
  misc_feature (374)..(374): n is a, c, g, or t
  modified_base (422)..(422): a, c, t, g, unknown or other
  misc_feature (422)..(422): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctccctgtctgtgtctccgtggggaagagccaccctctcctgcagggccagtcagagcgttggcaggaacttagcctggtaccagcagaaacctggccagccctcccagacctcctcctctatcggtcnccttccaccgacgggcccctgactactccccgctaggttcagtggcaggtcgggtctaggggaccnggtacgttccactctacaccatcagcacgcctgccagtctagaagttntttgacttagtttacttacgttggtctaaccgtagttaactaaacgttaaccgtcggtaccgttccgggttggtaccggtttcgggaccggtaaacggggaacccgtaaaggggttacgggaaaacgaccgtaaaaacggtccgttagggttcgggacttcgggaccgtaacccgtattccgttacggttccgtttcgttaaccccg

SEQ ID NO: 357927 - DNA, 583 bp, Homo sapiens
  misc_feature: GZ8MTXP01DF6R8.25.32.C10.1.454.CMB.2.raw
  modified_base (306)..(306): a, c, t, g, unknown or other
  misc_feature (306)..(306): n is a, c, g, or t
  modified_base (380)..(380): a, c, t, g, unknown or other
  misc_feature (380)..(380): n is a, c, g, or t
  modified_base (401)..(401): a, c, t, g, unknown or other
  misc_feature (401)..(401): n is a, c, g, or t
  modified_base (428)..(428): a, c, t, g, unknown or other
  misc_feature (428)..(428): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaaggagccaccctctcctgcaggccagtcagagcgttggcaggacttagctggtaccagcagaaacctggccagccctcccagacctccctcctctatgggtcnccttccaacgacgggccccctagactacgtcccccgctaggttccaggtcggctaggtcgggtcgtaggggacngtacgtccactctccaccgtntccagcagccctgctagtctagaagtnttttgctaagtttactactggtacctactagtaactaatacgtcggtccgtcggtggtaccgtttacggaccgaaaggggaaccgaaagggttaggaaacgaccgaaaacgtacgttggttcggacgtgacaactatcttacgttcttccgtaac

SEQ ID NO: 357928 - DNA, 524 bp, Homo sapiens
  misc_feature: GZ8MTXP01BPL4K.25.32.C10.1.454.CMB.2.raw
  modified_base (205)..(205): a, c, t, g, unknown or other
  misc_feature (205)..(205): n is a, c, g, or t
  modified_base (301)..(301): a, c, t, g, unknown or other
  misc_feature (301)..(301): n is a, c, g, or t
  modified_base (361)..(361): a, c, t, g, unknown or other
  misc_feature (361)..(361): n is a, c, g, or t
  modified_base (363)..(363): a, c, t, g, unknown or other
  misc_feature (363)..(363): n is a, c, g, or t
  modified_base (436)..(436): a, c, t, g, unknown or other
  misc_feature (436)..(436): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactttggctcccagatgccactggagaaattgtgatgacgcagtctccagcctccctgtctgtgtctcctggggaagngccaccctctcctgcagggccagtcagagcgttggcaggacttagcctggtaccagcagaacctggccagcctcccagacctcctcctctatggtnccttccaccacgggcccctgactactccccgcaggttcagtcggcagtggtctgggaacngngttcactctcaccatcagcagcctgcagtctagaagtattttgctagtttatactgttcactagtataatacngtcctcgtggacgtttggactaagggaccaagggtcggaaagcaaacgaacgtgttaggcttggcaccaatctgttcttcaagttccc

SEQ ID NO: 357929 - DNA, 542 bp, Homo sapiens
  misc_feature: GZ8MTXP01BKKJQ.25.32.C10.1.454.CMB.2.raw
  modified_base (205)..(205): a, c, t, g, unknown or other
  misc_feature (205)..(205): n is a, c, g, or t
  modified_base (370)..(370): a, c, t, g, unknown or other
  misc_feature (370)..(370): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctccgtggggaagngccaccctctcctgcagggccagtcagagcgttggcaggaacttagcctggtaccagcagaaacctggccagcctcccagacctcctcctctatggtcgccttccaccgacgggccccctgactactccccgcaggttcacgtggctaggtcgggtctggggacnggtacgttccactctacaccatcagcagcctgccagtctagatatttgctagtttatactggtcactagtataatacgtcgcctccgtgtacgtttggaccgtaaggggaaccaagggttaggaaacgacgaaacgtacttggttgctgcaaccatcttagtccttctaacc

SEQ ID NO: 357930 - DNA, 612 bp, Homo sapiens
  misc_feature: GZ8MTXP01D9FEO.25.32.C10.1.454.CMB.2.raw
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (272)..(272): a, c, t, g, unknown or other
  misc_feature (272)..(272): n is a, c, g, or t
  modified_base (441)..(441): a, c, t, g, unknown or other
  misc_feature (441)..(441): n is a, c, g, or t
tcagactgtacagtcacgaccggtgctcgatttagtatagacatcaacacacaaaggggggaggaactgctcagttaggacccagacggaaccatggaagccccagcgcagcttctcttcctcctgctactctggctcccagatgccatggagaaattgtgatgacgcagtctccagccctccctgtctgtgtctccgtggggaagcnccaccctctccngcaggccagtcagagtcgttggcaggtaacttgcctggtaccagcagaaccnggaccacgcctcccagtacctcctcctctagtggtctccttaccgacccgacgggtcccccttagactaccttcccccgctaggttccaggtcggctagggtcgggtctaaggggactaaggactttccactctaccacatccagcagctcgcagtatagtagtagttntatagtttattacttcgtactacctagttaattaactaacgtcgtaccgttccgtcggttacggttacggtacgaacgggtaaccggaaggttagggaaacgaacgaaaccgtaagttacggttggttacgtaacggtacaaccgtactcgttcgttccgttcgtttcccg

SEQ ID NO: 357931 - DNA, 661 bp, Homo sapiens
  misc_feature: GZ8MTXP01DHV3S.25.32.C10.1.454.CMB.2.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagagccaccctctcctgcagggccagtcagagcgttggcaggaacttagcctggtaccagcagaaacctggccagccctcccagacctcctcctctatggtcgccttccaccgacgggtccccctgacttacctcccccgctaggttccaggtcggacgtaggtcggggtccgtaggggaacctaagggtacgtttccaaccttcctaccaacccgtatccgaacgcacgccctgcctagtctaggtaaagttattttcgacttaaggttttacttacgtgggttacctacgtaaagttaattaaacttaaccgtcggtacccgttacggttcgggtaacgttttcgggaaccgtaaagggggtaaccctaaaggggttacgggaaaacgacgtaaaaacggtacgttagggcgggacttcgacctaaccgtattccgttacgttccgttcgtaaccg

SEQ ID NO: 357932 - DNA, 583 bp, Homo sapiens
  misc_feature: GZ8MTXP01DIGFH.25.32.C10.1.454.CMB.2.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagcnccaccctctcctgcagggcctgtcagngtcgttggcaggacttagcctggacagcagaaacctggccagccctccagacctccctcctctatggtcgcccttccgaccgacgggcccccttgacttaccgtcccccgctagggttccaggtcggcaggtggggtctaggggactggacgttcactctccacatcagcagcctgctagtctagattagtttgcttaatttacttactggttacaacgtattaataactacgtcggaccgttccgtgggtaacgtttcggaaccgaaaggggtaaccgaagggttacggaaacgaccgtaaaacgacgttggttacggctcgactaacctatcgttcttcttctaacc

SEQ ID NO: 357933 - DNA, 650 bp, Homo sapiens
  misc_feature: GZ8MTXP01ACNYD.25.32.C10.1.454.CMB.2.raw
  modified_base (460)..(460): a, c, t, g, unknown or other
  misc_feature (460)..(460): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtgggggaagacgccaccctctcctgcagggccagtcagagcgttgcaggacttgcctggaccagcagaaacctggccacgcctcccagacctccctcctctagtggtcgccttacccgaccgacgggggccccctaggaccttaccgtcccccgcgtacgggttccaggtcggcgtagggttcggggtctaggggaccaaggtacgtttccaccgtcctccaaccgtatccaacgcacgtccctggcctagtctagtaacgtnttttgcttagtttacttacgtcggtacaactagttaattaaacgtaaccgtcggtcccttaccggtacggtaccggtttacggaccgtaaacggggtaaccgaaagggttacgggaaacgaccgtaaaacggtaacgttggttacgggccttaaggaccctaacgtacttcgttcgttccgttctaaccg

SEQ ID NO: 357934 - DNA, 571 bp, Homo sapiens
  misc_feature: GZ8MTXP01BCJW0.25.32.C10.1.454.CMB.2.raw
  modified_base (380)..(380): a, c, t, g, unknown or other
  misc_feature (380)..(380): n is a, c, g, or t
  modified_base (529)..(529): a, c, t, g, unknown or other
  misc_feature (529)..(529): n is a, c, g, or t
  modified_base (549)..(549): a, c, t, g, unknown or other
  misc_feature (549)..(549): n is a, c, g, or t
  modified_base (558)..(558): a, c, t, g, unknown or other
  misc_feature (558)..(558): n is a, c, g, or t
  modified_base (569)..(569): a, c, t, g, unknown or other
  misc_feature (569)..(569): n is a, c, g, or t
tcagactgtacagtcacgaccggtgctcgatttagtatagacatcaacacacaaaggggggaggaactgctcagttaggacccagacggaaccatggaagccccagcgcagcttctcttcctcctgctactctggctcccagatgccactggagaaattgtgatgacgcagtctccagccctccctgtctgtgtctccgtggggaagacgcccaccctctcctgcagggccagtcagagcgttggcagggtactgcctggaccagcagaacctggccagcctccagcctccctcctctagtggtcgccttcccgaccgacgggcccctgactacctcccccgctaggttccaggtggctagggtgggtccgtaggggacngtagttccactctacaccatccagccagccgtgctaggtctagtaagttatttcgacttagtttattactcggtacaacgtataactaatacgtcgtccgtacggtggtaccggttggaccgaaaggggaacctaagggttaggaaacncgaaaacggtgttgttggcngccaacctntcttctcttcncg

SEQ ID NO: 357935 - DNA, 539 bp, Homo sapiens
  misc_feature: GZ8MTXP01C4W2W.25.32.C10.1.454.CMB.2.raw
  modified_base (300)..(300): a, c, t, g, unknown or other
  misc_feature (300)..(300): n is a, c, g, or t
  modified_base (493)..(493): a, c, t, g, unknown or other
  misc_feature (493)..(493): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctcgtggggaagacgccaccctctcctgcagggccagtcagagcgttggcaggacttagcctggtaccagcagaacctggccagcctccagacctcctctctatggtcnccttccaccgacgggcccctgactactccccgctaggttcaggtggactaggtggggtcctaggggacaaggtacgttcacttcacaccatcagcacgcctgcagtctagagtatttgctagtttatactgtacacgtatataatactgcctcgtggtacgttggaccgaagggtaaccaaggttaggaaacncgaaaacgtacttggttcggctgcaacctatcgttatccttgaacc

SEQ ID NO: 357936 - DNA, 620 bp, Homo sapiens
  misc_feature: GZ8MTXP01CTMDY.25.32.C10.1.454.CMB.2.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctcgtggggaagacgccaccctctcctgcagggccagtcagagcgtggacaggaacttagcctggtacagcagaaacctggccagccctccagacctcctcctctatggtcgccttccaccgacgggcccctgactacctccccgacgtaggttccaggtcggacaggttcggggtcgtaggggactaaggtacgtttccaaccttccacaccctatccgacgcacgccctggactagtctagtaagtatttgacttagtttacttacgtggtacactaagtaacttaaactaacgtcggtaccttaccgggtaggtaccggtttacggaccgaaaggggtaaccgtaaagggttaacgggaaacgacgtaaaacggacgttagggttcgacgtaagacctaacgtatcttacgttcttaacgtaaccg

SEQ ID NO: 357937 - DNA, 644 bp, Homo sapiens
  misc_feature: GZ8MTXP01DR18P.25.32.C10.1.454.CMB.2.raw
  modified_base (304)..(304): a, c, t, g, unknown or other
  misc_feature (304)..(304): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccatggagaaattgtgatgacgcagtctccagcctccctgtctgtgtctccgtggggaagcgccaccctctcctgcagggccagtcagagcgttggacaggaacttagcctggtaccagcagaaactggccagcctccagacctccctcctctatggtcnccttccaccgacgggcccccttagactactcccccgctaggttccaggtcggcgtaggttggggtccgtagggggactgggtacgtttccaaccttcctaccaaccctattccaagccacgcccgtgaccgtagttactaggtaaacgttatttttcggactttagttttaattaccgttagggttaccctaactaaagttaacttaaactaaccgttcggtacccgttaccggtagggtacggtttacggaccgtaaacggggaaccaaagggttacggaaaacgacgaaaaccgtagttggttggacctgcctaacctatcttagttccttctaaccg

SEQ ID NO: 357938 - DNA, 566 bp, Homo sapiens
  misc_feature: GZ8MTXP01AQD5Q.25.32.C10.1.454.CMB.2.raw
  modified_base (234)..(234): a, c, t, g, unknown or other
  misc_feature (234)..(234): n is a, c, g, or t
  modified_base (302)..(302): a, c, t, g, unknown or other
  misc_feature (302)..(302): n is a, c, g, or t
  modified_base (421)..(421): a, c, t, g, unknown or other
  misc_feature (421)..(421): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagcgccaccctctcctgcagggccagtcagngcgttggcaggacttgcctggtaccagcagaactggccagcctcccagacctcctcctctatcggtcnccttccaccgacgggcccctgactactccccgcgtaggttcacggtggctaggtcggggtctaggggacaaggtacgttccactctcaccatcgagcagcctgctagtctagtaagttntttgacttagtttacttactgtacactagtactaatacgtggcctcgtggtcgttcggaccgaagggaacctaagggttacgaaagcgtaaacgtacgttgggttcggcgtaacgccgtaactagtcgttcgtccttcgtaaccg

SEQ ID NO: 357939 - DNA, 699 bp, Homo sapiens
  misc_feature: GZ8MTXP01AOTLQ.25.32.C10.1.454.CMB.2.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctccctgtctgtgtctccgtgggggaagagcccaccctctcctgcagggccagtcagagcgttggcaggaacttagcctggtacagcagaaacctggccagccctcccagacctccctcctctagtcggtcgtcctttacccgacccgtacgggggcccccctaggaccttacctccccccggcctacgggtttccaggtcggctagggtcggggtctagggggactggtacgtttccaaccttcctccaaccctattcgaacgccgaacggcctacgccgaaggttccgttaggtaaagttactttttaggaccttaaggtttttaacttaaccgttcgggttactaaacccggttaaagttaacgttaaaacttaaccgtcgggtaccctttccgggtagggtaccggtttacggacccgtaaaggggtaacccgaaagggttagggaaaacgcgaaaaacgggtacttagggttcggcttaacggaccaacctagttccttagttcctttcgtaacc

SEQ ID NO: 357940 - DNA, 639 bp, Homo sapiens
  misc_feature: GZ8MTXP01B7NV3.25.32.C10.1.454.CMB.2.raw
  modified_base (206)..(206): a, c, t, g, unknown or other
  misc_feature (206)..(206): n is a, c, g, or t
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccatggagaaattgtgatgacgcagtctccagccctcctgtctgtgtctccgtggggaagcnccaccctntcctgcagggccagtcagngtcgttggcaggactgctggaccagcagaactggccacgccctccagacctcctcctctagtggtctccttccgaccgacggcccctgactacctcccccgcgtaggttccaggtcggacgtaggtcggggtcgtaggggacctaaggtacgtttccaccttcctaccaacccgtataccgacgcacggcctggacctaggttctagtaagttactttgactttaagttttaacttacgttggtaacctaaccgtaagttaactaaacgtaaccgtcggtcccttaccgggttaggtaccggtttacggaccgtaaaggggaacccgtaaaggggttacggaaacgaccgtaaaacggtacgttggttcggactcgacctaacctagtcgttcgtccttcgtaacc

SEQ ID NO: 357941 - DNA, 749 bp, Homo sapiens
  misc_feature: GZ8MTXP01ERU1E.25.32.C10.1.454.CMB.2.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctccctgtctgtgtctccgtggggaagcgcccaccctctcctgcgaggccagtcagagtcgttggcaggacttagccgtggtaccagcaagaactcggccacgcctcccagacctccgtcctctagtcggtcgtccttacccgaccgtacggggtccccctaggtaccttaccgtccccccggtccgtacgggtttaccgaaccggttcggggacctaaggggttcgggggtaccggtaacgggggaaccttaagggtacgtttaccgaaccgttcccttaccgaacctaagttcccgaacggtaccaacggtcccgttaggaccgtacggttaccgtaggttaaacgtttgtttttacgtacgtttaaagttttaacttacgttacgggttacctaaccgttaaagttaacttaaacgtaaccgttccggtacccgtttaccgggttacggttaccggtttaccgggacccgtaaaggggtaacccgtaaagggttaacggaaacggttaacgaaacggtacgttaggttcgacgtcgactaacctatccgttagttccttcgtaaccg

SEQ ID NO: 357942 - DNA, 760 bp, Homo sapiens
  misc_feature: GZ8MTXP01C86YD.25.32.C10.1.454.CMB.2.raw
  modified_base (209)..(209): a, c, t, g, unknown or other
  misc_feature (209)..(209): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccatggagaaattgtgatgacgcagtctccagccctccctgtctgtgcctccgtgggggaagacncccaccctctcctgcagggccagtcagagcgtggcaggacttgctggacagcagaactgccagccctccagacctcctcctctatcggtcgccttccaccgacgggtcccccttagactaccgtcccccgcgtaggttccaggtcggcgtaggtggggtcgtaggggtacctaaggtacgttaccctaccttcctaccaacccgtataccgacgaccgacggtcccgttggaccttaacggttacgttaggttaaagtttacgtttttacggtactttaaggtttttaaactttaccgtttcggggttaacctaacccgttaaaggtttaaacttaaacgtttaaaccgttccggggttacccgtttacccggggttacgggggtttaacccggttttacgggggaaacccgggttaaaacggggaaaacccggtaaagggggttaaaccgggtaaaacggaccggtaaaaaccggttacgttaggggttacgttaccggtaacggtaccctaacctacgttcctttcggtttaacccttccgttaacccg

SEQ ID NO: 357943 - DNA, 758 bp, Homo sapiens
  misc_feature: GZ8MTXP01ET9SJ.25.32.C10.1.454.CMB.2.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (262)..(262): a, c, t, g, unknown or other
  misc_feature (262)..(262): n is a, c, g, or t
  modified_base (279)..(279): a, c, t, g, unknown or other
  misc_feature (279)..(279): n is a, c, g, or t
  modified_base (312)..(312): a, c, t, g, unknown or other
  misc_feature (312)..(312): n is a, c, g, or t
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactcctggctcccagatgccactggagaaattgtgatgacgcagtctccagcctcctgtctggtntctcgtgggggactagccaccctntcctgcgagggccagtcagagcggttggcaggactagctggtaccngacacgaaacctggccngccctcccagaccttccctcctctatcgggtcncttccaacccgtacgggccccttagacttaccgtcccccgactacgggtttaccaggttcggacgtaggggttcggggtcctagggggacctaaggtacgtttccacttccncaccctancgacgacgacgtccgtcgcgtacgtacgtagtagtttacgtttacgttacgtttaacgttttacttacgtacggtccttcccgttaacgttaaacgttaaacgttaaaccggttaccgggttacccggtttaccggggttacggggttaccgggttaaccgggtaacccggggtaaaaccgggggtaaaaccgggtaaacggggttaaacggggtaaaacggaaaccggtaaaaccggtaacggaacggggttacgggttaccggtaaccggtacccgtaacccgtacgttaccgtttaccgtttaaccgttaacccgttaacccg

SEQ ID NO: 357944 - DNA, 692 bp, Homo sapiens
  misc_feature: GZ8MTXP01ELJPM.25.32.C10.1.454.CMB.2.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctccctgtctgtgtctccgtggggaagacgcccaccctctcctgcgagggccagtcagagcgttgcaggtactagctgacagcaagaacctggccacgccctcccacgtacctccctcctctatcggtctccttcccaccgacgggtccccctagactacctcccccgcgtacggttcacggtcggcgtagggtcgggtcgtaggggactggtacgttcaccttcctaccaccgtatacgacgcacgtcctgaccgtagtacgttaggtaaacgtttgtttacgtactttaagtttaacttacgtacgttaaccgtaaacgttaagttaaacttaaacttaccggttccggtacccgtttacgggttacgggttaccgggttacggaaccgggtaaacgggtaaaccggtaaaggggttaaacggaaaacggaaaccgtaaaacggtacgttcgggttcggttaccgtaacggacctaaccgttacgttccgttacgtttccttccgtaaccg

SEQ ID NO: 357945 - DNA, 616 bp, Homo sapiens
  misc_feature: GZ8MTXP01BMVQQ.25.32.C10.1.454.CMB.2.raw
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (282)..(282): a, c, t, g, unknown or other
  misc_feature (282)..(282): n is a, c, g, or t
  modified_base (290)..(290): a, c, t, g, unknown or other
  misc_feature (290)..(290): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctccctgtctgtgtctccgtggggaagacgccaccctctcctgcagggccagtcagagcgttgcaggactgctgacngcagacngcagcctccagctcctctntatggtcnccttccaccgacgggccccctgactaccgtccccgcgtaggttcacggtcggcgtaggtgggtctaggggacaaggtacgtcactctaccgaccatcagcagtcctgcctagttactagtaagttatttgacttaagtttacttacttggtacctaaccgtaagttaactaaacgttaccgtacggtcccgttaccgggttacggttaccgggtttacgggaccgtaaacggggtaacccggtaaagggttagggaaaacgttacggaaaacgtacggttggttggaccgtaaggaccaacgtacttcgttcgttcttcgtaaccg

SEQ ID NO: 357946 - DNA, 506 bp, Homo sapiens
  misc_feature: GZ8MTXP01EB8UA.25.32.C10.1.454.CMB.2.raw
  modified_base (205)..(205): a, c, t, g, unknown or other
  misc_feature (205)..(205): n is a, c, g, or t
  modified_base (356)..(356): a, c, t, g, unknown or other
  misc_feature (356)..(356): n is a, c, g, or t
  modified_base (435)..(435): a, c, t, g, unknown or other
  misc_feature (435)..(435): n is a, c, g, or t
  modified_base (494)..(494): a, c, t, g, unknown or other
  misc_feature (494)..(494): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaagnccacctctcctgcagggccagtcagagcgttggcaggaacttgcctggtacagcagaaacctggccagcctcccagacctcctcctctatggtgcttccaccacgggcccctgactactccccgcaggttcagtggcagtggtctgggacngagttcactctcaccatccagcagcctgcagtctgtagtatttgctagtttattacgttgtactactataataatacgngtctcgtgtcgttgacgaggaacgaaggagaacgacgaaacgacgttgcgctgcaactntcttntcttctn

SEQ ID NO: 357947 - DNA, 661 bp, Homo sapiens
  misc_feature: GZ8MTXP01C6K2Y.25.32.C10.1.454.CMB.2.raw
  modified_base (212)..(212): a, c, t, g, unknown or other
  misc_feature (212)..(212): n is a, c, g, or t
  modified_base (257)..(257): a, c, t, g, unknown or other
  misc_feature (257)..(257): n is a, c, g, or t
  modified_base (291)..(291): a, c, t, g, unknown or other
  misc_feature (291)..(291): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctccagatgccatggagaaattgtgatgacgcagtctccagcctcctgtctgtgtctcgtggggaagacgccaccctntcctgcgaggccagtcagagcgttgacaggaacttgcctggaccngacagaaactgaccagcctccatctcctaccgtntagtcggtctcctacccgaccggtcggtaccctagaccttaccgccccgtagtaggtcacggtcgcgtagggtcggtcgtaagggactcgtactccactccacactagacacgacgacgccgtacgacgtacgtacgttagtaagttagttacgttacgttaacgtttaacgttacgttacggtaactaacgtaacgttaaacttaaacgtaacgtacgtaccgttaccggttacggttaccggttaccggtaccggtaacgggtaacggtaaacggttaaacggtaaacggaaacgtaaaccgtaacgttacggttcggttaccgtaacgtaccgtaaccgtacgtacgttacgttccgttcgtaaccg

SEQ ID NO: 357948 - DNA, 598 bp, Homo sapiens
  misc_feature: GZ8MTXP01EAUZX.25.32.C10.1.454.CMB.2.raw
  modified_base (375)..(375): a, c, t, g, unknown or other
  misc_feature (375)..(375): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctccctgtctgtgtctccgtggggaagagccaccctctcctgcagggccagtcagagtcgttggcagggaactagcctggtacagcagaaacctggccagcctcccagacctcctcctctatggtctcttccgaccgacggggccccctgactactcccccgcgtaggttcaggtggctaggtggtctaggggacnggtacgttccactcctcacctatccacgcaggcctgcagttctagtaagtctttgacttagtttattacgtggtactactagttaactaataacgtcggtacctcggtggtacgtttcgggaccgtaacgggaaccgtaagggttacggaaacgttacgaaaacggtaacgttgggttcggttctcggacctaaccgtatcgttcgttaaccgttccgtaacc

SEQ ID NO: 357949 - DNA, 734 bp, Homo sapiens
  misc_feature: GZ8MTXP01D3WQE.25.32.C10.1.454.CMB.2.raw
  modified_base (348)..(348): a, c, t, g, unknown or other
  misc_feature (348)..(348): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctccgtggggaagacgccaccctctcctgcagggccagtcagagtcgttggactaggtaacttgcctaggtaccagccaagaaacctggccacgccctaccagacctccctcctctagtggtcgccttccgaccgtacggcccccttagacttaccncccccgcgtaggttccacggttggacgtagggtcgggtccgtaacgggggaactaagggtaccgtttccaaacctttcctaacccgaacctactaccgaacgtccgacggtccctggtaccgtaaggttaccgttaagggtaaactttaggttttacgtaacctttaaggtttttaacttaaccggtttacggttaaccctaaaccgttaagttaaacttaaacgttaacgtccggttaccgttacccggttagggttaccggtttacgggaacccggtaaaggggaaccgtaaagggttacggaaaacgaccgtaaaacggtacgttagggttcgttaccgtggaccctaaccgttcgttcgttacgttcgttaaccgtaacccg

SEQ ID NO: 357950 - DNA, 571 bp, Homo sapiens
  misc_feature: GZ8MTXP01E0XWL.25.32.C10.1.454.CMB.2.raw
  modified_base (409)..(409): a, c, t, g, unknown or other
  misc_feature (409)..(409): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (449)..(449): a, c, t, g, unknown or other
  misc_feature (449)..(449): n is a, c, g, or t
  modified_base (546)..(546): a, c, t, g, unknown or other
  misc_feature (546)..(546): n is a, c, g, or t
  modified_base (549)..(549): a, c, t, g, unknown or other
  misc_feature (549)..(549): n is a, c, g, or t
  modified_base (555)..(555): a, c, t, g, unknown or other
  misc_feature (555)..(555): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtgggggaacgacgcccaccccttctcccgttggcacggggcccaaggtccaggagcggtttggcagggtaccttagcctggtaccagcagaaaccgtggccacgccctcccagtacctccctcctctagtcggtcgcctttacccgaccgacgggcccccttagactaccgtcccccgcgtacggttcacggtcgggctagggtcggtacgngggtaccaaggtactcactctacacacncacncncgcngntagtagagtattgtcgtacttattactactcgtacactatactacgtcgtcgtcgtcgacgtcgtacgacgacgaacgagagacaacgaacgtcccngcncgcacnctctcttctcttctcg

SEQ ID NO: 357951 - DNA, 698 bp, Homo sapiens
  misc_feature: GZ8MTXP01AY34X.25.32.C10.1.454.CMB.2.raw
  modified_base (204)..(204): a, c, t, g, unknown or other
  misc_feature (204)..(204): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctcgtgggaagcnccaccctctcctgcagggccagtcagagcgttggcgaggaacttagcctggtaccagcagaaaccgtggccagccctaccagtacctccctcctctatcgggtctccttccgacccgacgggtcccctagaccttccgtcccccgcgtaggtttcgacggtggcgtaggttcggggtaccgtagggggacctaaggtacgtttacctaccttcccgtacaacctactaccgacggaccaacggtccgtcgtaccgtacgttaccgttaagggtaatttacgttttaggtactttaaggttttaactttacctacggggttactaaaccgttagttaaacttaaacgttaacgtccggtaccgttaccgggttacggtacgggtttaccggaaccgggtaaacggggtaacccgaaaggggttacggaaaacgaccgtaaacggtaacgttggttcgcgtaacgctaacctacgtcttcgttccgttcgtaaccc

SEQ ID NO: 357952 - DNA, 673 bp, Homo sapiens
  misc_feature: GZ8MTXP01ENE0M.25.32.C10.1.454.CMB.2.raw
  modified_base (239)..(239): a, c, t, g, unknown or other
  misc_feature (239)..(239): n is a, c, g, or t
  modified_base (402)..(402): a, c, t, g, unknown or other
  misc_feature (402)..(402): n is a, c, g, or t
  modified_base (464)..(464): a, c, t, g, unknown or other
  misc_feature (464)..(464): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctccctgtctgtgtctccgtaggggaagacgcccaccctctcctgcgagggccagtcagngcgttgacaggactgctgtaccagcagaacctggccacgcctaccgagacctcctcctctagtcggtcgtccttaccgaccgtacgggcccccttaggaccttaccgtcccccgacgtacggtttcacggtcggacgtagggttcgggtcgtaacggggaacnggtacgttaccaccttcctacaccatccacgcgacgcctagcctagtacgtagtaaagtttntttacgacttagtttacttacgtacgtaactaacgttaagttaacgttaaacgttaccggtccggtaccgttaccgggttacggttaaccggttacggaaaccggtaaacggggtaaaccgtaaagggttaacggaaaacgttaacgtaaacggtacgttcggttcgactaacgacctaacgtcgttcgttcgttaaccgttcgtaacc

SEQ ID NO: 357953 - DNA, 574 bp, Homo sapiens
  misc_feature: GZ8MTXP01A10TB.25.32.C10.1.454.CMB.2.raw
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (312)..(312): a, c, t, g, unknown or other
  misc_feature (312)..(312): n is a, c, g, or t
  modified_base (325)..(325): a, c, t, g, unknown or other
  misc_feature (325)..(325): n is a, c, g, or t
  modified_base (357)..(357): a, c, t, g, unknown or other
  misc_feature (357)..(357): n is a, c, g, or t
  modified_base (401)..(401): a, c, t, g, unknown or other
  misc_feature (401)..(401): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccatggagaaattgtgatgacgcagtctccagcctccctgtctgtgtctccgtggggaacgcgccaccctctcctgcagggccagtcagagcgttggcaggtacttagcctggtaccagcagaacctggccagcctccagactcctcctntatggtcncttccaccgnggcccctgactcncccgctaggtcagtcgcagtggtctagggacngtacgtcactctcacatccagcagtcctgcagtctagaagtttnttagacttagttactacgtcggtacaacgtagtaactaacgtacgtcgtaccgttcggtacggtaccggtacggaaccggaaggtaacgtaagggttacgaaacgttaccgtaaacggtcgttcggttcgttctcgacctaaccgtacgttcgttacttccgttccgtaaccg

SEQ ID NO: 357954 - DNA, 761 bp, Homo sapiens
  misc_feature: GZ8MTXP01DVMR6.25.32.C10.1.454.CMB.2.raw
  modified_base (207)..(207): a, c, t, g, unknown or other
  misc_feature (207)..(207): n is a, c, g, or t
  modified_base (232)..(232): a, c, t, g, unknown or other
  misc_feature (232)..(232): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagcnccacctctctgcagggcctgtcagngcgttggcaggtactagctggtacagacaacgaacctggaccacgccctacccagtaccttccctcctgtacgtcggtcgtcccttccccgacccggtacgggtcccccttaggaaccttaccgtccccccgtacgtacggttccgaaggtcgggactaggggttcgggtccgtaaggggaacctaagggtacgtttcccgaacttccgtaccaaccgtatacccgtacgaccgtacggtccgttcggaccgtaggttaccgttaaggttaaaggtttcgtttttacgacccgttttaaggttttaaccgtttacgttacggggttaaaccctaaccgtttaaagttaaacgttaaaacgttaaccggttccggtacccgtttaccggggttacggtttaaccgggtttacgggaaacccggtaaacggggaaaccgtaaggggttaacggaaacgaacgtaaaaccgtaggttacggttcggttaccgttcggacctaacctgttccgttacgttcctttaactcccg

SEQ ID NO: 357955 - DNA, 688 bp, Homo sapiens
  misc_feature: GZ8MTXP01B87TE.25.32.C10.1.454.CMB.2.raw
  modified_base (237)..(237): a, c, t, g, unknown or other
  misc_feature (237)..(237): n is a, c, g, or t
  modified_base (309)..(309): a, c, t, g, unknown or other
  misc_feature (309)..(309): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctccctgtctgtgtctccgtgggggaagcgccaccctctccgtgcagggccagtcagngcgttggcaggtacttagcctggtaccagcaagaacctggccagccctcccagcctcctcctctagtggtcnccttccaccgacgggtccccctgaccttaccgtcccccgcgtacggttcacggtcggacgtagggtcggggtcgtaaggggacctaagggtacgttcccgaccttcctaccaaccgatccacgccgacgcccgttgccgtaggtacgttaggtaaagttgttttacgactttaagttttactttaccgttacgggttaaccctaaccgtaagttaacttaaaccgttaaccgttccgggtacccgtttccggtacgggttaccggtttcgggaaccggtaacgggaacccggtaaagggttagggaaacgacgtaaaacggtacggttcgttcggttcgtcgtaccaaccgtagttccttacggttccttcgtaacccg

SEQ ID NO: 357956 - DNA, 882 bp, Homo sapiens
  misc_feature: GZ8MTXP01AOBPU.25.32.C10.1.454.CMB.2.raw
  modified_base (208)..(208): a, c, t, g, unknown or other
  misc_feature (208)..(208): n is a, c, g, or t
  modified_base (216)..(216): a, c, t, g, unknown or other
  misc_feature (216)..(216): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccatggagaaattgtgatcgacgcagtctccagcctccctgtctgtgtctcgtaggggaagacnccaccctntcctgcagggccagtcagagtcgttggcaggaacttagcctggaccagacaacgaaccgtggaccacgccctacccgagaccttccctcctctacgtggtcgtcccttacccgacccgaccgggtccccctggtacctaccgtaccccccggaccgttacggttaccgaccggttcggggaccggtaggggttcgggggtacgttaacgggggacctaaggttacggtttacccaacctttccctacccgaaaccctaaggttacccgaacgacccgaaccggtcccgtcgggtaccgttaacggttacccggttaaggttaaaggtttacgttttttacgggtaaccctttaacggtttttaaacctttacggtacccggggtttaacctaacccggttaaagtttaaacgtttaaaaccgtttaaaccggttcccgggttaccccgtttacccgggggttaacggggtttacccgggtttttaaccggggaaaccccgggtttaaaacgggggaaaccccggtaaaagggggttaaaccggggtaaaaaccggaaacccggtaaaaaccggtaaccggtttacgggttacggttacccgttaaccgggaaccctaaccggttaacttacccggtttcgttaacccgttaaccgtttaaccccgg

SEQ ID NO: 357957 - DNA, 689 bp, Homo sapiens
  misc_feature: GZ8MTXP01EV3X5.25.32.C10.1.454.CMB.2.raw
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
  modified_base (261)..(261): a, c, t, g, unknown or other
  misc_feature (261)..(261): n is a, c, g, or t
  modified_base (295)..(295): a, c, t, g, unknown or other
  misc_feature (295)..(295): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccatggagaaattgtgatgacgcagtctccagccctcctgtctgtgtctcgtggggaagcnccaccctntcctgcagggccagtcagagtcgttgcaggtactgctgcagcagaacnggccacgcctccagacctcctcctctatcggtcnccttccaccgacgggccccctgactactcccccgctacggttcacggtcggacgtagggtcgggtcgtaacggggactaaggtacgttacaccttcctacgtaccataccgaacgcctacggcctggcctaggttacctagggttaaacgttagttttacgggaccttaaggttttaacttaccgtttacggggttaacctaacccgttaaagttaaaccttaaacgttaaccgtcgggtacccctttacgggttacgggtaccggtttagggacccgtaaacggggtaaccgtaaaggggttcgggaaaacgttaccgaaaccggtaaacggttgggttcgttacgtaaggacccgtaaccgtacttccgttcgttaaccgtttccgtaaccg

SEQ ID NO: 357958 - DNA, 729 bp, Homo sapiens
  misc_feature: GZ8MTXP01ER75X.25.32.C10.1.454.CMB.2.raw
  modified_base (168)..(168): a, c, t, g, unknown or other
  misc_feature (168)..(168): n is a, c, g, or t
  modified_base (284)..(284): a, c, t, g, unknown or other
  misc_feature (284)..(284): n is a, c, g, or t
tcagactgtacagtcacgaccggtgctcgatttagtatagacatcaacacacaaaggggggaggaactgctcagttaggacccagacggaaccatggaagccccagcgcagcttctcttcctcctgctactctggctcccagatgccatggagaaattgtgatgacgnagtctccagcctcctgtctgtgtctccgtggggaagcgccacctctctgcgacggccagtcaggagtcggttggacgacggtaacttagccgtaggtaccagtacaacggtaaccncggaccaacgccctacccagtaacccttccctacctcgttagtggggtcctacccgttacccgaccggtaccggggtcccccttaggaccttaccgttacccccggacgttaggggttccaggtcgggtacgtaggggttcgggtcccgtaagggggaactgggtactttccaccttactacctaaccgattaccgacgactacggtcctggacctaggttacttaaggtaattacgtttagacgttattttaacttacgttacgtaactaacgttaaggtttaactaaagttccggtcggttaccgttaccgggttagggttaccgtttacgggaccggaaagggggtaaccgtaaggggttaacgggaaaccttacggaaaacgttacgggttggacgttacgtcggacttaaccgtcttccggttatttccgttaacgttcc

SEQ ID NO: 357959 - DNA, 600 bp, Homo sapiens
  misc_feature: GZ8MTXP01CQAKU.25.32.C10.1.454.CMB.2.raw
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
  modified_base (381)..(381): a, c, t, g, unknown or other
  misc_feature (381)..(381): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccatggagaaattgtgatgacgcagtctccagcctcctgtctgtcgtctccgtagggggaacgacgccaccctctcctgacagggccaagtcaggagcggttgactaggaacttagcctaggtaccagcaagaaacctggaccagcctccagactccnctntatggcncttaccacgcggcccctgactacgtcccgactaggttcaaggtcggactaggtcgggtcctagggaacngagttccaaacttccanaccgatccaancacncngcagtagtagtagtattagtatattattactacgtactaactaagtaactaataacgtacgtcgtacgtacggtacggtacggaacggaacggaaacggtaaaggttaaggtaaacgaaacgtaaacgtaacgttacggttcgttacgtaacgactaactactacttacgttaacgttcgtaacg

SEQ ID NO: 357960 - DNA, 503 bp, Homo sapiens
  misc_feature: GZ8MTXP01E1P6A.25.32.C10.1.454.CMB.2.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (234)..(234): a, c, t, g, unknown or other
  misc_feature (234)..(234): n is a, c, g, or t
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
  modified_base (389)..(389): a, c, t, g, unknown or other
  misc_feature (389)..(389): n is a, c, g, or t
  modified_base (456)..(456): a, c, t, g, unknown or other
  misc_feature (456)..(456): n is a, c, g, or t
  modified_base (472)..(472): a, c, t, g, unknown or other
  misc_feature (472)..(472): n is a, c, g, or t
  modified_base (475)..(475): a, c, t, g, unknown or other
  misc_feature (475)..(475): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
  modified_base (486)..(487): a, c, t, g, unknown or other
  misc_feature (486)..(487): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
tcagactgtacagtcacgaccggtgctcgatttagtatagacatcaacacacaaaggggggaggaactgctcagttaggacccagacggaaccatggaagccccagcgcagcttctcttcctcctgctactctggctcccagatgccactggagaaattgtgatgacgcagtctccagcctccctgtctgtgtctcctggggaagngccaccctntcctgcagggccagtcagngcgttggcaggacttagcctggtaccagcagaaaccctggccagccctccccagacctccctcctctatcgggtagccttcccacccaggggccccctgactactcccccggcaggttcaggtggcngtggggctggggaccngacgttcactcncactatcagcagcctgccagtctagaatatttgctagtttatactgtcacagtataatactgctcgngtacgtgcaggcaggngancgaagangngnngcncntcngtcttcnc

SEQ ID NO: 357961 - DNA, 665 bp, Homo sapiens
  misc_feature: GZ8MTXP01DWH4V.25.32.C10.1.454.CMB.2.raw
  modified_base (143)..(143): a, c, t, g, unknown or other
  misc_feature (143)..(143): n is a, c, g, or t
  modified_base (153)..(153): a, c, t, g, unknown or other
  misc_feature (153)..(153): n is a, c, g, or t
  modified_base (205)..(205): a, c, t, g, unknown or other
  misc_feature (205)..(205): n is a, c, g, or t
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
tcagactgtacagtcacgaccggtgctcgatttagtatagacatcaacacacaaagggggaggaactgctcagtttaggacccagacggaaccatggaagccccagcgcagcttctcttcctcctgctactctggctcccagntgccatgganaaattgtgatgacgcagtctccagcctcctgtctgtgtctcgtgggaaggcnccncctctcngcgcgcgagngagngtgtgngagtactcgcgtcgtacgacgacgacgacgacgacacgcctaccactcctcctcctcgtacgtcgtcgtcctaccgaccgaccgtaccgtacgtacgtaccgtcccgtacgtacgtcgtacgtcggtcgtcggtcggtcggtaacggtacgtcgtacgtacgtactactacctactactacgacgacgacgtcgtcgtacgttacgtacgtacgtaagttacgttacgttacgttacgtttacgttacgttacgtacgtaacgtaagttaacgttaacgttacgtccgtaccgttacggttacggttacggttacggtaacggaacggtaaacggtaaacggttaaacggtaaaacgttaaacgtaacgtacggttacggttcgttacgtaaccgtacgtaacgttcttcgttacttaacgttccgtccg

SEQ ID NO: 357962 - DNA, 652 bp, Homo sapiens
  misc_feature: GZ8MTXP01BJ3L0.25.32.C10.1.454.CMB.2.raw
  modified_base (214)..(214): a, c, t, g, unknown or other
  misc_feature (214)..(214): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (355)..(355): a, c, t, g, unknown or other
  misc_feature (355)..(355): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctccgtggggaagagccaccctntcctagcagggccagtcagagtcgttggcaggaacttagcctggaccagcaagaactggccagcccacacgactcctccctntagtggtcncttccaccgtacgggcccctgaacttccgccccgcaggttcagttcgganacggtcgggtactggggacaagtacgttcactcctacacctaatccacggtcacggtccgtgaccgtagttacgagttaacgttagttttacgaccttaagttttattacccgtaggggttaccctaaaccgtaggttaaaccttaagtaaccgtcggtacccgttcggttacggtcggtttacgggacctaaacgggggaacctaaaggggttcgaaacgcggttaaacccgaaggttcggttacgttcgtaacggtacctaacccttaggtccttcgttaaccgttccgtaaccg

SEQ ID NO: 357963 - DNA, 525 bp, Homo sapiens
  misc_feature: GZ8MTXP02F8NIC.25.32.C10.1.454.CMB.2.raw
  modified_base (303)..(303): a, c, t, g, unknown or other
  misc_feature (303)..(303): n is a, c, g, or t
  modified_base (359)..(359): a, c, t, g, unknown or other
  misc_feature (359)..(359): n is a, c, g, or t
  modified_base (405)..(405): a, c, t, g, unknown or other
  misc_feature (405)..(405): n is a, c, g, or t
  modified_base (418)..(418): a, c, t, g, unknown or other
  misc_feature (418)..(418): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagagcgttggcaggaacttagcctggtaccagcagaaacctggccagcctcccagactcctcctctatggtncttccaccagggcccctgatatccccgcaggttcagtggcagtgggtctggggacngagttcactctcaccatcagcagccctgcagtctgaagaatttgtntagtttattactntcacatataataactacgtctcgtcggtacgttcgtacgaacggacgaaggtaggaaacgaacgaaacgaacgtacgtggcgtcgacaccactactcgtcttactac

SEQ ID NO: 357964 - DNA, 505 bp, Homo sapiens
  misc_feature: GZ8MTXP02JLVKP.25.32.C10.1.454.CMB.2.raw
  modified_base (303)..(303): a, c, t, g, unknown or other
  misc_feature (303)..(303): n is a, c, g, or t
  modified_base (362)..(362): a, c, t, g, unknown or other
  misc_feature (362)..(362): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaagagccaccctctcctgcagggccagtcagagcgttggcaggacttagcctggtaccagcagaaacctggccagccctcccagacctcctcctctatggtnccttccaccgacgggcccctgactactccccgcaggttcagtgcagtgggtctgggacngagttcactctcacatcagcagcctgcagtctgatatttgctagtttattactgtcactagtataatactgcctcgtgacgttgacgtaagggaccaaggtgaaaacgcaaacgactggtgctgcacgtactctgtcctctac

SEQ ID NO: 357965 - DNA, 565 bp, Homo sapiens
  misc_feature: GZ8MTXP02FWQ9C.25.32.C10.1.454.CMB.2.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
  modified_base (368)..(368): a, c, t, g, unknown or other
  misc_feature (368)..(368): n is a, c, g, or t
tcagactgtacagtcacgaccggtgctcgatttagtatagacatcaacacacaaagggggagaaactgctcagttaggacccagacggaaccatggaagccccagcgcagcttctcttcctcctgctactctggctcccagatgccactggagaaattgtgatgacgcagtctccagcctccctgtctgtgtctcctggggaagngccaccctctcctgcagggccagtcagagcgttggcaggacttagcctggtaccagcagaaacctggccagccctcccagacctcctcctctatggtnccttccaccacgggcccctgactactccccgctaggttcaggtcggcaggtcgggtctggggacngggtacttcacgtcctaccaacctatcagcacgcctgcagtctagaagttatttgacttagtttatactgtacactataataatacgtgcctcggtggtacgttacggaccgaaagggaccgtaaggggtaggaaaacgacgaaaacggtaacgttcgggacggactaacgaccaacgtactcgttacgtctactac

SEQ ID NO: 357966 - DNA, 549 bp, Homo sapiens
  misc_feature: GZ8MTXP02FYCY2.25.32.C10.1.454.CMB.2.raw
  modified_base (303)..(303): a, c, t, g, unknown or other
  misc_feature (303)..(303): n is a, c, g, or t
  modified_base (365)..(365): a, c, t, g, unknown or other
  misc_feature (365)..(365): n is a, c, g, or t
  modified_base (378)..(378): a, c, t, g, unknown or other
  misc_feature (378)..(378): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaagagccaccctctcctgcagggccagtcagagcgttggcaggaacttagcctggtaccagcagaaacctggccagccctcccagactcctcctctatggtnccttccaccacgggccccctgactactccccgcaggttcacgtggcaggtgggtctgggacngtagttcacttcncacatcagcacgcctgcagtctgaagtatttgactagtttatactgtcactagtataataactggtacctccgtggacgtttggacgtaagggacctaagggtacggaaacgacaaaacggtaacgtagtacggctaacggccaacctagtccgttagtctttactaaccg

SEQ ID NO: 357967 - DNA, 551 bp, Homo sapiens
  misc_feature: GZ8MTXP02FS48M.25.32.C10.1.454.CMB.2.raw
  modified_base (206)..(206): a, c, t, g, unknown or other
  misc_feature (206)..(206): n is a, c, g, or t
  modified_base (376)..(376): a, c, t, g, unknown or other
  misc_feature (376)..(376): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagngccaccctctcctgcagggccagtcagagcgttggcaggaacttagcctggtaccagcaagaaacctggccagcctcccagacctccctcctctatcggtcgtccttccaccgacgggccccctgacttactcccccgcaggttcacggtggcaggtgggtctggggacnggattcactcctcacatcagcacgctgcagtcagtaagtattttgacttagtttattactgtacactagtaataataacgtgcctcgtgtacgttaggaccgaagggaccaagggtacggaaaagacgaaaacgtacgtagtggactcgaccacctatcgtcgtaccttactacg

SEQ ID NO: 357968 - DNA, 527 bp, Homo sapiens
  misc_feature: GZ8MTXP02JNRU8.25.32.C10.1.454.CMB.2.raw
  modified_base (303)..(303): a, c, t, g, unknown or other
  misc_feature (303)..(303): n is a, c, g, or t
  modified_base (361)..(361): a, c, t, g, unknown or other
  misc_feature (361)..(361): n is a, c, g, or t
  modified_base (402)..(402): a, c, t, g, unknown or other
  misc_feature (402)..(402): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagagcgttggcaggacttagcctggtaccagcagaaacctggccagcctccagacctcctcctctatggtcncttccaacgacgggcccctgactactccccgcaggtcagtgcagtgggtctggggacngtagttcactctcaccatcagcagcctgcagtctagaagtntttgactagtttatactgtacactagtataataactggtacctcgtgtacgtttggaccgaagggtaccaagggtacgaaacgacgaaaacggactggtacgcgtgacacctatctcgtctctac

SEQ ID NO: 357969 - DNA, 590 bp, Homo sapiens
  misc_feature: GZ8MTXP02H7N6J.25.32.C10.1.454.CMB.2.raw
  modified_base (365)..(365): a, c, t, g, unknown or other
  misc_feature (365)..(365): n is a, c, g, or t
  modified_base (406)..(406): a, c, t, g, unknown or other
  misc_feature (406)..(406): n is a, c, g, or t
  modified_base (414)..(414): a, c, t, g, unknown or other
  misc_feature (414)..(414): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaagagccacctctcctgcagggccagtcagagcgttggcaggacttgcctggtaccagcagaaacctggccagccctccagacctcctcctctatggtcgccttccaccgagggcccctgactactccccgctaggttcacgtggccaggtgggtctggggacngagtttcactctcaccatcagcagcctgcagtactgaagtntttacgtnttagtttattactcgtactaactagtataactacgtcggtccttcggtacggttacggttacggaccggtaaacgggtaacgtaagggtaacggaaaacgtaaccgaaaacggtacgtacggtacggacgtaacggacccgtaaccgtacgttaccgtcgtttacctttacgtacg

SEQ ID NO: 357970 - DNA, 540 bp, Homo sapiens
  misc_feature: GZ8MTXP02IING4.25.32.C10.1.454.CMB.2.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (368)..(368): a, c, t, g, unknown or other
  misc_feature (368)..(368): n is a, c, g, or t
tcagactgtacagtcacgaccggtgctcgatttagtatagacatcaacacacaaagggggaggaactactcagttaggacccagacggaaccatggaagccccagcgcagcttctcttcctcctgctactctggctcccagatgccactggagaaattgtgatgacgcagtctccagcctccctgtctgtgtctcctggggaaggngccacctcncctgcaggggccagtcagagcgttggcagggaacttagcctggtaccagcagaaacctggccagccctcccagactccctcctctatggtgcttcccacacgggcccctgactactcccccgcaggttcagtcggcagtgggtctgggacagngttcactctcaccatcagcagccctgcagtctgaagtattttgctagttattactgtacaccagtataataactggacctcgttggtacgtttggacgtaaagggacctaaagggtacggaaaagcgaaaacgaactgtacggctgaacgaccattctgtctttcattcccg

SEQ ID NO: 357971 - DNA, 506 bp, Homo sapiens
  misc_feature: GZ8MTXP02JEE29.25.32.C10.1.454.CMB.2.raw
  modified_base (354)..(354): a, c, t, g, unknown or other
  misc_feature (354)..(354): n is a, c, g, or t
  modified_base (391)..(391): a, c, t, g, unknown or other
  misc_feature (391)..(391): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctcctggggaagagccaccctctcctgcagggccagtcagagcgttggcaggacttagcctggtaccagcagaaacctgccagcctccagacctcctcctctatggtgcttccacagggccccctgactactccccgcaggttcagtgcagtggtctgggacngatcactctcacatcagcagcctgcagtctgaagttnttgactagtttatactgtactactatataatacgtcgtctcgtgtacgttgacgaaggacgaaggtagaaacgacgaaacgacgtcgtcgactgacactactctcgtactactac

SEQ ID NO: 357972 - DNA, 538 bp, Homo sapiens
  misc_feature: GZ8MTXP02I2QGP.25.32.C10.1.454.CMB.2.raw
  modified_base (370)..(370): a, c, t, g, unknown or other
  misc_feature (370)..(370): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaagagccaccctctcctgcagggccagtcagagcgttggcaggaacttagcctggtaccagcagaaacctggccagcccctcccagacctccctcctctatggtgccttccaccgacgggccccctgactactccccgccaggttcagtggcaggtgggtctggggacnggtcgttcactctcaccatcagcagcctgcagtctagaagtatttgctagtttattactgtcactagtataaatacgtggcctcgtggtacgtttggacgtaagggaccgaagggtaggaaacgacgaaaacgtactacggtgctgacacgtactcgtcgtcttctac

SEQ ID NO: 357973 - DNA, 541 bp, Homo sapiens
  misc_feature: GZ8MTXP02JG8UH.25.32.C10.1.454.CMB.2.raw
  modified_base (233)..(233): a, c, t, g, unknown or other
  misc_feature (233)..(233): n is a, c, g, or t
  modified_base (301)..(301): a, c, t, g, unknown or other
  misc_feature (301)..(301): n is a, c, g, or t
  modified_base (368)..(368): a, c, t, g, unknown or other
  misc_feature (368)..(368): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaagagccaccctctcctgcagggccagtcagngcgttggcaggactagcctggtaccagcagaaacctggccagcctccagacctcctcctctatggtcnccttccaccgagggccccctgactactccccgcctaggttcacgtggcaggtcggggtctggggacnggtacgttcacttctcaccatcagcagcctgcagtctagaagtattttgactagtttattactgtcacagttataatactgacctcgtggtacgtttggaccgtaagggaccgaagggtaggaaacgacgaaaacgtacgtaggtaggactgacacctatctcgtcttactac

SEQ ID NO: 357974 - DNA, 505 bp, Homo sapiens
  misc_feature: GZ8MTXP02FOKO3.25.32.C10.1.454.CMB.2.raw
  modified_base (362)..(362): a, c, t, g, unknown or other
  misc_feature (362)..(362): n is a, c, g, or t
  modified_base (394)..(394): a, c, t, g, unknown or other
  misc_feature (394)..(394): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagagcgttggcaggaacttagcctggtaccagcagaaacctggccagcctcccagacctcctcctctatggtgcttccaccacgggccccctgactactccccgcaggttcagtgcagtgggtctgggacngagttcactctcacatcagcagcctgcagtcngaagtatttgctagtttatactgtcactagtataataactggcctcgtgacgttggcaagggaccaaggtagaaacgcaaacgactgtggactgcaccgatctgtcttcac

SEQ ID NO: 357975 - DNA, 647 bp, Homo sapiens
  misc_feature: GZ8MTXP02IGK72.25.32.C10.1.454.CMB.2.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctcgtggggaagacgccaccctctcctgcagggccagtcagagcgttggcaggacttagcctggtaccagcaagaaacctggaccacgccctcccagacctccctcctcgtatcggtcgtccttccaccgacgggccccctgactactcccccgcgtaggttccagtcggccgtaggtgggtcgtggggactggtagttcaccttctaccacatcacgcacgcctggcctagttacgtagtaagttatttcgacttagttttaactttacgtgttacctaaaccgtaattaattaaactaaccgttcggtacccttcgggttacgggttaacggtttcgggaacccggtaaaaggggtaccgtaaaaggggtacggaaaacggtaaccgaaaacggtaccgtaggttacggacgtaacggacgtaccgtacttccgttcgttactttacgtacccg

SEQ ID NO: 357976 - DNA, 525 bp, Homo sapiens
  misc_feature: GZ8MTXP02HEEOZ.25.32.C10.1.454.CMB.2.raw
  modified_base (363)..(363): a, c, t, g, unknown or other
  misc_feature (363)..(363): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccacctctcctgcagggccagtcagagcgttggcaggacttagcctggtaccagcagaaacctggccagccctcccagacctcctcctctatggtgccttccaccagggccccctgactactccccgcaggttcagtggcaggtgggctggggacngagttcactctcaccatcagcagcctgcagtctgaagtatttgatagtttattactgtacaccatataataactggctcggtgacgtttggaccaagggtaccaagggtaggaaagacgaaaacgaactaggtcggactgacacctatcgtcgtctttactc

SEQ ID NO: 357977 - DNA, 563 bp, Homo sapiens
  misc_feature: GZ8MTXP02HVT9S.25.32.C10.1.454.CMB.2.raw
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
  modified_base (365)..(365): a, c, t, g, unknown or other
  misc_feature (365)..(365): n is a, c, g, or t
  modified_base (432)..(432): a, c, t, g, unknown or other
  misc_feature (432)..(432): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctcgtgggaganccacctctcctgcagggccagtcagagcgttgcaggacttgcctggacagcagaaacctggccagcctcccagacctcctcctctatggtcnccttccaccgacgggcccctgactacctccccggcagggttcaggtcggctaggtggggtctaggggacnggtacgttccacttcctacaccatccagcagcctgcagtctagagtatttgacttagtttattactntacactaataataatacgtcgtaccttcggtaggtacggttagaccgtaaagggaacgaaagggtaacggaaacgtacgaaaacgtacgtaggtacgacgtaacgacaacttacgtctcgttacttacacg

SEQ ID NO: 357978 - DNA, 521 bp, Homo sapiens
  misc_feature: GZ8MTXP02GKPJF.25.32.C10.1.454.CMB.2.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (358)..(358): a, c, t, g, unknown or other
  misc_feature (358)..(358): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaagngccaccctctcctgcagggcctgtcagagcgttggcaggacttagcctggtaccagcagaaacctggccagcctcccagacctcctcctctatggtnccttccaccagggcccctgatactccccgcaggttcagtgcagtgggtctgggacngagttcactctcaccatcagcagcctgcagtctgaagttnttgactagtttattactntacactataataatacgtcgtcctcgtggtacgttagacgaacggacgaaggtaggaaacgacgaaacgtacgtacgacgactgacactactcgtcgtctactac

SEQ ID NO: 357979 - DNA, 591 bp, Homo sapiens
  misc_feature: GZ8MTXP02FNGXI.25.32.C10.1.454.CMB.2.raw
  modified_base (206)..(206): a, c, t, g, unknown or other
  misc_feature (206)..(206): n is a, c, g, or t
  modified_base (371)..(371): a, c, t, g, unknown or other
  misc_feature (371)..(371): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccggatgccactggagaaattgtgatgacgcagtctccagcctccctgtctgtgtctccgtggggaagngccaccctctcctgcagggccagtcagagcgttggcaggacttagcctggtaccagcagaaacctggccagccctcccagacctcctcctctatggtcgccttcccaccgacgggccccctgactactcccccgcaggttcagtcggcagtgggtctgggacagngttcactctcaccatcagcagccctgcagtctgaagtatttgctagtttattactgtacacctagttaataacttaacgtcgtccctacggttggtaaccggtttcggaccgtaaaggggaccctaaaggggtacggaaaacgaccgaaaacggtaacgtgggtacggccgttacgaacccgtaaccgtacttcccgtagtttcccttacactttccccg

SEQ ID NO: 357980 - DNA, 518 bp, Homo sapiens
  misc_feature: GZ8MTXP02GHF10.25.32.C10.1.454.CMB.2.raw
  modified_base (235)..(235): a, c, t, g, unknown or other
  misc_feature (235)..(235): n is a, c, g, or t
  modified_base (305)..(305): a, c, t, g, unknown or other
  misc_feature (305)..(305): n is a, c, g, or t
  modified_base (369)..(369): a, c, t, g, unknown or other
  misc_feature (369)..(369): n is a, c, g, or t
  modified_base (380)..(380): a, c, t, g, unknown or other
  misc_feature (380)..(380): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaaggagccaccctctcctgcagggcctgtcagngcgttggcaggaacttagcctggtaccagcagaaacctggccagcctcccagacctcctcctctatggtnccttccaccgacgggccccctgactactcccccgcaggttcagtggcaggtgggtctggggacnggattcactcncacatcagcagcctgcagtcngaagtnttttgactagtttatactgtacactagtataatactggcctcgtggtacgttggacgaaggacaaggtggaaacgcaaacgactggtagctgacactactctcgtctctac

SEQ ID NO: 357981 - DNA, 600 bp, Homo sapiens
  misc_feature: GZ8MTXP02HJ3X0.25.32.C10.1.454.CMB.2.raw
  modified_base (308)..(308): a, c, t, g, unknown or other
  misc_feature (308)..(308): n is a, c, g, or t
  modified_base (382)..(382): a, c, t, g, unknown or other
  misc_feature (382)..(382): n is a, c, g, or t
  modified_base (425)..(425): a, c, t, g, unknown or other
  misc_feature (425)..(425): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtgggggaagacgcccaccctctcctgcagggccagtcagagcgttggcaggacttagcctggtaccagcagaaacctggccacgcctcccagacctcctcctctatggtcnccttccaccgacgggccccctagactacctccccgactacggttcacgtcggcctaggtcgggtcgtggggacngtacgttcactctcaccatcagcagcctgcagtctgaagtttnttgacttatttattactcgtactacgtattaataactacgtcggtccgttcggtacggtacgttacggacgtaacgggtaaccgtaaagggtaacggaaacgtaaccgtaaaacggtacgtacggacggtacgtaacgacctaacgtacgttaccgtcgttacctttacgtaccg

SEQ ID NO: 357982 - DNA, 577 bp, Homo sapiens
  misc_feature: GZ8MTXP02JRZ9V.25.32.C10.1.454.CMB.2.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagagccaccctctcctgcagggccagtcagagcgttggcaggaacttagcctggtaccagcagaaacctggccagccctcccagacctccctcctctagtggtgccttccgaccgacgggcccctgactactcccccgctaggttcaggtcggctaggtggggtctaggggactggtacgttcacctctccactatcacgccagcctgctagtctagtaagtgttttgacttagtttattactgtacactagtataaatacgtggtccctcggtggtacgtttcggaccgaaagggtaccgaagggtacggaaacgtacgaaaacgacgtggtacggctaacggaccaacctagtcctcgttaccttctaaccg

SEQ ID NO: 357983 - DNA, 509 bp, Homo sapiens
  misc_feature: GZ8MTXP02HU9PO.25.32.C10.1.454.CMB.2.raw
  modified_base (206)..(206): a, c, t, g, unknown or other
  misc_feature (206)..(206): n is a, c, g, or t
  modified_base (233)..(233): a, c, t, g, unknown or other
  misc_feature (233)..(233): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (419)..(419): a, c, t, g, unknown or other
  misc_feature (419)..(419): n is a, c, g, or t
  modified_base (495)..(495): a, c, t, g, unknown or other
  misc_feature (495)..(495): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagngccacctctcctgcagggccagtcagngcgttggcaggacttagcctggtaccagcagaaacctggccagcctccagacctcctcctctatggtcgccttccaccgacgggcccctgactactccccgcaggttcagtgcagtggtntgggacngtagttcactctcaccatcagcagctgcagtctagaagtatttgctagtttattacgtnttcagactaagtaataaaacgtgtaccgtagtagtttgacgagggacagcgtaggacagtacagacgaatgaagcncacactactctctc

SEQ ID NO: 357984 - DNA, 601 bp, Homo sapiens
  misc_feature: GZ8MTXP02JP3DO.25.32.C10.1.454.CMB.2.raw
  modified_base (255)..(255): a, c, t, g, unknown or other
  misc_feature (255)..(255): n is a, c, g, or t
  modified_base (377)..(377): a, c, t, g, unknown or other
  misc_feature (377)..(377): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagcgccaccctctcctgcagggccagtcagagcgttggcaggactgctgacngcagaacctggccagcctccagacctcctcctctatcggtcgtccttccaaccgacggggtccccctagacttacctcccccgacgtaggttcacggtcggctaggtcggggtctggggacnggtacgttcactctacacatcagcagcctgcagtctaggaagtatttgacttagtttactactgtactacctagttaactaagtaccgtcggtacccttccggtaggtaccggtttcggaccgtaaacggggtaccgtaaagggtacggaaaacgacgaaaaccggtacgtacggtacggactaaggccctaaccgtattccgtacgttacccttcgtaacccg

SEQ ID NO: 357985 - DNA, 520 bp, Homo sapiens
  misc_feature: GZ8MTXP02GX7J6.25.32.C10.1.454.CMB.2.raw
  modified_base (301)..(301): a, c, t, g, unknown or other
  misc_feature (301)..(301): n is a, c, g, or t
  modified_base (357)..(357): a, c, t, g, unknown or other
  misc_feature (357)..(357): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggcctgtcagagcgttggcaggacttagcctggtaccagcagaaacctggccagcctccagactcctcctctatggtnccttccaccagggcccctgactactccccgcagttcagtgcagtgggtctgggacngagttcactctcaccatcagcagcctgcagtctagaagtatttgctagtttatactgtcacctagtaataataacctggtcctcgtggtacgtttggcgtaaaggaccaagggtgaaacgacgaaacgaacgtgtcggactcgactaccattctgtactctac

SEQ ID NO: 357986 - DNA, 580 bp, Homo sapiens
  misc_feature: GZ8MTXP02HJJCP.25.32.C10.1.454.CMB.2.raw
  modified_base (207)..(207): a, c, t, g, unknown or other
  misc_feature (207)..(207): n is a, c, g, or t
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (348)..(348): a, c, t, g, unknown or other
  misc_feature (348)..(348): n is a, c, g, or t
  modified_base (369)..(369): a, c, t, g, unknown or other
  misc_feature (369)..(369): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagcnccaccctctcctgacacgggccagtcagagtcgtgcaggactgctgaccngcagaacctggccagccncagctcctcntntgtnctcacncggccctgactcgccccgcaggttccagtcggcaggtgggtactggggacnggggtcttcactctcacctancgacgcacgtctcgcgtacgtcgtagtagttagttacgtacgttagtttacgttacttacgtacgtacgtacgttaactaacgtaacgtacgtacgtacgtacggtacggttacggtacgtaacggtaacggtaacggtaacggaaacgaaacgaaacgtaacgtacgtacgtacgtaacgtacgtacgtacgtacgtcgtacgtactacg

SEQ ID NO: 357987 - DNA, 542 bp, Homo sapiens
  misc_feature: GZ8MTXP02FT5AH.25.32.C10.1.454.CMB.2.raw
  modified_base (374)..(374): a, c, t, g, unknown or other
  misc_feature (374)..(374): n is a, c, g, or t
  modified_base (417)..(417): a, c, t, g, unknown or other
  misc_feature (417)..(417): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaaggagccaccctctcctgcagggccagtcagagcgttggcaggaacttagtctggtaccagcagaaacctggccagccctcccagacctcctcctctatggtcgccttcccaccgacgggccccctgactacctcccccgcaggttcaggtggcaggtgggtctggggacngagttcactctcaccatcagcagccctgcagtctaggtaagtntttgacttagtttattactgtacacctagtaataataacgtgccttcggtggacgtttggaccgaagggaccagggtaggaaacgaacaaacgactagtggcgtgcgaccatcgtcgtcttctac

SEQ ID NO: 357988 - DNA, 526 bp, Homo sapiens
  misc_feature: GZ8MTXP02GAL4T.25.32.C10.1.454.CMB.2.raw
  modified_base (301)..(301): a, c, t, g, unknown or other
  misc_feature (301)..(301): n is a, c, g, or t
  modified_base (357)..(357): a, c, t, g, unknown or other
  misc_feature (357)..(357): n is a, c, g, or t
  modified_base (395)..(395): a, c, t, g, unknown or other
  misc_feature (395)..(395): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctcctggggaagcgccacctctcctgcagggccagtcagagcgttggcaggacttagcctggtaccagcagaaacctggccagccctcccagacctcctcctctatggtnccttccaccagggcccctgactactccccgcaggttcagtgcagtggtctgggacngagtcactctcacatcagcagcctgcagtctagaagtntttgactagtttattactgtacactagtaataataactggcctacggtgtacgtttgacgaaggaccgtaaggtggaaacgacgaaaacgacgtagtaggacctaagacaactacgtctacgtcttactac

SEQ ID NO: 357989 - DNA, 562 bp, Homo sapiens
  misc_feature: GZ8MTXP02I3XC0.25.32.C10.1.454.CMB.2.raw
  modified_base (233)..(233): a, c, t, g, unknown or other
  misc_feature (233)..(233): n is a, c, g, or t
  modified_base (268)..(268): a, c, t, g, unknown or other
  misc_feature (268)..(268): n is a, c, g, or t
  modified_base (373)..(373): a, c, t, g, unknown or other
  misc_feature (373)..(373): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaagagccaccctctcctgcagggccagtcagngcgttggcaggacttagcctggtacagcagaaccnggccagcctccagacctcctcctctatggtcgcttcccaccgacgggccccctgactaccgtccccgccgaacggttcacgtcggccgaggtcggggctgggacnggtagttccacgtctaccacatcagccagtctggacgccgtagaacgtatttgctagtttattactgtcagcagcgtagctaggtcggtccggtcgggtacgtaggtttcggaccgtacggggtaccgacggtcgtggaacgacgtacgaaacgacgtaaggtcggcgtacggcaccctagtcgttacg

SEQ ID NO: 357990 - DNA, 565 bp, Homo sapiens
  misc_feature: GZ8MTXP02JVDSK.25.32.C10.1.454.CMB.2.raw
  modified_base (207)..(207): a, c, t, g, unknown or other
  misc_feature (207)..(207): n is a, c, g, or t
  modified_base (262)..(262): a, c, t, g, unknown or other
  misc_feature (262)..(262): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtgggggaagngccaccctctcctgcagggccagtcagagcgttggcaggacttagcctggtaccngcagaaacctggccagcctccagacctcctcctctagtggtgtccttccaccgacgggcccctgactactccccgctacggttcacgtcggcagggtcgggtcgtggggacaggtacgttcaccgttcacaccatccgacgcacgccctgcagtcagtacgtatttgcttatttatctgtctactagtactaatacgtcgtctcggtcggtacgtttacggacgtaacgggaccgaaggtacggaaacgacgaaacgtaacgtggtacggactcgaccacgtactcgtacgtaccttactacc

SEQ ID NO: 357991 - DNA, 582 bp, Homo sapiens
  misc_feature: GZ8MTXP02J3LFV.25.32.C10.1.454.CMB.2.raw
  modified_base (239)..(239): a, c, t, g, unknown or other
  misc_feature (239)..(239): n is a, c, g, or t
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (382)..(382): a, c, t, g, unknown or other
  misc_feature (382)..(382): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaacggacgcccaccctctccgtgcagggccagtcagngcgttgcaggaactgcctggaccagcagaacctggccagcctccagacctcctcctntatcggtnccttccacgcgggccctgactactccccgctagttccagtcgcaggtggtcngggacnggacttcactctacacctancagcgacgccgtgacgtagtcgtagtaagttagtttcgtacttagtttacttactcgtactactaagttaacttaacgtacgtcggtacccgttacggttacggtacgttacggaaccgtaaaggtaacgtaagggtaacgaaacgaacgaaacggacgtacggtacgactcgaccacgtactcgtacgttactactacg

SEQ ID NO: 357992 - DNA, 627 bp, Homo sapiens
  misc_feature: GZ8MTXP02HYT7D.25.32.C10.1.454.CMB.2.raw
  modified_base (381)..(381): a, c, t, g, unknown or other
  misc_feature (381)..(381): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagacgccaccctctcctgcagggccagtcagagcgttggcaggaacttgcctggtaccagacagaaacctggccagcctcccagacctcctcctctagtggtcgccttcccgaccgacgggtcccctagactaccgtcccccgcacggttcacggtggctaggtcgggtctggggacngtacgttcactctcacatcagcacgcctgcagtcgtagaagttatttcgacttagtttacttacttcgtactaacgtagttaactaaactacgtccggtaccttaccgggttacggttaccggtttcggaaccgtaaaaggggtacccgtaaaaggggttacggaaaaacgacgtaaaaccggtaacgtaggttacggacttaacggaacctaaccgtagttaccgttacgttcctttactacccg

SEQ ID NO: 357993 - DNA, 507 bp, Homo sapiens
  misc_feature: GZ8MTXP02FIY1J.25.32.C10.1.454.CMB.2.raw
  modified_base (204)..(204): a, c, t, g, unknown or other
  misc_feature (204)..(204): n is a, c, g, or t
  modified_base (357)..(357): a, c, t, g, unknown or other
  misc_feature (357)..(357): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagaaaccaccggcgaaattgtgttgacacagtctccagccaccctgtcttgtctccaggggaaangccacgctctcctgcagggccagtcagagtatcggcaggtccttagcctggtatcgacagagccctggccaggctcccaggctcctcatctatgatgcatccaacagggcccatgacgtccagacaggttccagtgcaggtgggctggggacngacttcactctcaccatcagcagtctagagcctgaagtatttgctagtttattactgccagcagcgtaagcgacgtggcctaccgtataagtttcggccgaggggacctaggggtcgacttcgaagtcgaatggtggctcgcacatctcg

SEQ ID NO: 357994 - DNA, 609 bp, Homo sapiens
  misc_feature: GZ8MTXP02FMG67.25.32.C10.1.454.CMB.2.raw
  modified_base (378)..(378): a, c, t, g, unknown or other
  misc_feature (378)..(378): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctccgtggggaagacgccaccctctcctgcagggccagtcagagcgttggcaggactagcctggacagcagaaacctggccagccctccagacctcctcctctagtcggtcgccttccaccgacgggccccctgacttacctcccccgctacggttcacggtcggctaggtcggggtcgtggggacnggtacgttcacttcctcacatccgagcacggccctgactagtctagtaagttagttttgacttagttttacttactgttaccaactagttaataactaacgtcggtaccttacggtaggtacgtttacggaccgtaaacgggaccgaaagggtaggaaaacgtacgaaaacggtaccgtggtacgggtactaacggacctaaccgtacttcgtacgttcctttacgtaccg

SEQ ID NO: 357995 - DNA, 495 bp, Homo sapiens
  misc_feature: GZ8MTXP02FNCIZ.25.32.C10.1.454.CMB.2.raw
  modified_base (357)..(357): a, c, t, g, unknown or other
  misc_feature (357)..(357): n is a, c, g, or t
  modified_base (391)..(391): a, c, t, g, unknown or other
  misc_feature (391)..(391): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaagagccaccctctcctgcagggccagtcagagcgttggcaggactagcctggtaccagcagaaacctggccagcctcccagactcctcctctatggtgccttccaccagggccccctgactactccccgcaggttcagtgcagtggtctgggacngacgttcactctcaccatcagcagcctgcagtcngaatctttgactagtttatactgtcacagtataatactggcctcgtgacgttgcaaggacaggtgaaacgcaaacgacagtgactgcacatctcgtactcgtac

SEQ ID NO: 357996 - DNA, 606 bp, Homo sapiens
  misc_feature: GZ8MTXP02JLSY1.25.32.C10.1.454.CMB.2.raw
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcgtggggaagcgcccacctctcctgcagggccagtcagagcgttggcaggtaacttgcctggtaccagcagaaacctggccagcctcccagacctcctcctntatcggtntccttaccaccgacgggcccccttgacttacccgtcccccgacgtagggtttccaggttcggcgtaggttcggggtctaggggaccagggtcttcaaccttcctacacctatccacgccacgccctgacctagttctaggaagtttagttttgactttattttataccgttgtaccctaacgtagttaattaacgtacgtcggtaccgttcgtgggtacgttggaaccgagggtaaccgaagggtacgaaacgacgtaaaacggtactggtgacgtcgcaacctgtcctagtccttctaccg

SEQ ID NO: 357997 - DNA, 655 bp, Homo sapiens
  misc_feature: GZ8MTXP02JCI8E.25.32.C10.1.454.CMB.2.raw
  modified_base (233)..(233): a, c, t, g, unknown or other
  misc_feature (233)..(233): n is a, c, g, or t
  modified_base (298)..(298): a, c, t, g, unknown or other
  misc_feature (298)..(298): n is a, c, g, or t
  modified_base (446)..(446): a, c, t, g, unknown or other
  misc_feature (446)..(446): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctcctgtctgtgtctccgtggggaagcgccacctctcctgcagggccagtcagngcgttggcaggactagcctggaccagcagaacctggccagcctccagacctcctcctctatggtnccttcccaccgacgggtccccctgactaccgtcccccgctaggttccaggtcggacgtaggtggggtcctaggggactagggtacgtttccacgttcctacgaaccctatccgagccacgtccctgacctaggttctaggtaaagttnttttagacctttaagtttacttacgttacgtacctaaccgttaagttaacttaaacgtaaaccggttcggtacccgtttccgggtagggttaccggtttacgggaaccgtaaacgggggtaaccgtaaaggggtaggaaaacgtaacgaaaacggtacgtacggtacggactaacggacctaccgtacgtcttacgttaccttactacg

SEQ ID NO: 357998 - DNA, 573 bp, Homo sapiens
  misc_feature: GZ8MTXP02HBJEJ.25.32.C10.1.454.CMB.2.raw
  modified_base (301)..(301): a, c, t, g, unknown or other
  misc_feature (301)..(301): n is a, c, g, or t
  modified_base (371)..(371): a, c, t, g, unknown or other
  misc_feature (371)..(371): n is a, c, g, or t
  modified_base (389)..(389): a, c, t, g, unknown or other
  misc_feature (389)..(389): n is a, c, g, or t
  modified_base (416)..(416): a, c, t, g, unknown or other
  misc_feature (416)..(416): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcgtggggaagcgccaccctctcctgcagggccagtcagagcgttggcaggacttagctggaccagcagaacctggccagccctccagacctcctcctctagtggtcnccttaccaacgacgggcccctgtactacctccccgcgaggttcacgtggctaggtggggtctaggggacnggtacttcactcctcacntaccagcagccctgacagtcagtaatntttgacttagtttatactgactactagttaataataccgtggtccttccggtaggtacggtttacggaccgaaacggggtaaccgaaagggttacggaaaacgaccgaaaacggtacgtaggtaggcaacggccacgtatcgtacttcctactaccg

SEQ ID NO: 357999 - DNA, 546 bp, Homo sapiens
  misc_feature: GZ8MTXP02FUK79.25.32.C10.1.454.CMB.2.raw
  modified_base (205)..(205): a, c, t, g, unknown or other
  misc_feature (205)..(205): n is a, c, g, or t
  modified_base (232)..(232): a, c, t, g, unknown or other
  misc_feature (232)..(232): n is a, c, g, or t
  modified_base (364)..(364): a, c, t, g, unknown or other
  misc_feature (364)..(364): n is a, c, g, or t
  modified_base (404)..(404): a, c, t, g, unknown or other
  misc_feature (404)..(404): n is a, c, g, or t
tcagactgtacagtcacgaccggtgctcgatttagtatagacatcaacacacaaaggggggaggaactgctcagttaggacccagacggaaccatggaagccccagcgcagcttctcttcctcctgctactctggctcccagatgccactggagaaattgtgatgacgcagtctccagcctcctgtctgtgtctcgtggggaagngccacctctcctgcagggccagtcagngtcgttggcaggactagctggtaccagcagaaacctggccagcctccagacctcctcctctagtggtcgccttccaccgacgggcccctgactacctccccgctaggtcagtgctaggtcgggtctgggacnggtacttcactctcacatcagcagctagcagtcagtaatntttgacttagtttattactgttacactagtaataacgtaactcggtactcggtaggtacgttcggacgtaagggaccaagggtacggaaacgtacgaaacgtacgtagcggactcgccaactcgtacttacgtctacttacg

SEQ ID NO: 358000 - DNA, 591 bp, Homo sapiens
  misc_feature: GZ8MTXP02IGOZU.25.32.C10.1.454.CMB.2.raw
  modified_base (366)..(366): a, c, t, g, unknown or other
  misc_feature (366)..(366): n is a, c, g, or t
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccatggagaaattgtgatgacgcagtctccagcctcctgtctgtgtctccgtggggaagacgccaccctctcctgcagggccagtcagagcgttggcaggacttagctggacagcagaacctggccagcctccagacctcctcctctatggtctccttccaccgacgggcccctgactactccccgctaggttcacggtggcctaggtggggtctggggacnggtacgttcactctccacntcagcagtccngctagtctagtagttatttgacttagtttacttacgtcgtactaactagttaattaacgtacgtcggtccgttacggttacggttacggttacgggaccgtaaacgggaacgtaagggtaacggaaaacgtaaacgaaaacggtacgtacggtacgacgtaacgactacgtacgttacgttacgttcttacgtac

SEQ ID NO: 358001 - DNA, 674 bp, Homo sapiens
  misc_feature: GZ8MTXP02JIX5T.25.32.C10.1.454.CMB.2.raw
  modified_base (206)..(206): a, c, t, g, unknown or other
  misc_feature (206)..(206): n is a, c, g, or t
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (337)..(337): a, c, t, g, unknown or other
  misc_feature (337)..(337): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagngccaccctctcctgcagggccagtcagagcgttggcaggaacttgcctggaccagcaagaaacctggccagccctcccagacctcctctntatggtcncctccaccgacgggcccctgactacgtccccgntaggttcaggtggccaggttcgggtctaggggactaggtcgttccacgttcctaccaccctatcccagccacgtccctacgcgtagtcgtagtaaacgttgttttacgtacgttaagttttaactttaacgttcggttacctaaccgtaagttaaacttaaaacgttaaaccgttcgggtacccttccggttacgggtaacggttttacgggacccggtaaaacggggaaaccggtaaaggggtaacggaaaaccggaacggtaaaaccggtaaccgttacgggtacggaccgtaacggaccgtaaccgtaagtaccttacggttccttacgtaccg

SEQ ID NO: 358002 - DNA, 698 bp, Homo sapiens
  misc_feature: GZ8MTXP02I9KE3.25.32.C10.1.454.CMB.2.raw
  modified_base (311)..(311): a, c, t, g, unknown or other
  misc_feature (311)..(311): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctcctgtctgtgtctccgtggggaagacgccaccctctcctgcgacgggccagtcaggagtcgttggcaggtaacttagcctggaccagcaacgaacctggcccacgcccctacccgagtacctccctcctntacgtcggtctcctcccaccgacgggtcccctagactacccgtccccgctaggttccaggtcggcgtagggttcgggtcgtacggggactaggggtctttacccgaaccttcctaaccaccctatacccgacgaccgaccggtcccgtggacccgtaacggttcgttaaggttaagtttagtttttacgacgtttaagtttttaactttacgttacgtacctaacgttaagttaacttaaacgtacgttcggtaccgttcgggtcggttaacggtttacggaaccggaaacggtaacggtaaggggtaacggaaacgtaaaccgaaacggtaccgttggtacggtacgtaacgacgtacctagtccgttacgttaccttacttcccg

SEQ ID NO: 358003 - DNA, 706 bp, Homo sapiens
  misc_feature: GZ8MTXP02FUJ6V.25.32.C10.1.454.CMB.2.raw
  modified_base (206)..(206): a, c, t, g, unknown or other
  misc_feature (206)..(206): n is a, c, g, or t
  modified_base (233)..(233): a, c, t, g, unknown or other
  misc_feature (233)..(233): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagngccacctctcctgcagggccagtcagngcgtggcaggtactagcctggtaccagcaagaaacctggccagccctcccgagacctcctcctctagtggtctcccttacccaccggaccgggtcccctagaacttacccgtcccccggacgtacggttcacgggtcggaccgtagggttcggggtcgtacggggaactagggtacgttccaccgttccctacaaccctataccgacgcgaaccgtccgtagccgtagttacgtaggtaaagtttacgtttttcgaacgtttagtttttaacttacgtcggttaacctaacttaaagtttaaacttaaacgttaaccggtcggttacccgttccggggttacggttacggtttaccgggaaaccgggtaacgggtaaaaccggtaaggggttaaacggaaaacggtaacgtaaaacggtacgttacgggcggtacgaacgacctaaacgtctcgttacctcgtttactacccg

SEQ ID NO: 358004 - DNA, 641 bp, Homo sapiens
  misc_feature: GZ8MTXP02GHUIR.25.32.C10.1.454.CMB.2.raw
  modified_base (391)..(391): a, c, t, g, unknown or other
  misc_feature (391)..(391): n is a, c, g, or t
  modified_base (435)..(435): a, c, t, g, unknown or other
  misc_feature (435)..(435): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtgggggaagacgccaccctctcctgcagggccagtcagagcgttggcaggacttagcctggtaccagcagaaacctggccagccctccagacctccctcctctatcggtcgccttccgacccgcggggtccccctggactacccgtcccccgcctaaggttcacggtcggcctagggtcggggtcgtggggacngggtactttcaccttctacacctatccagcacgcctgctagtcnggtaattagtttgacttagtttacttactgtacctaactagtaattaactaccgttggtacccttcggtacgggtacgtttacgggaccgtaaaacggggtaccgtaaaaggggttacgggaaaacgtaaccgaaaacggtaaacgttcgggtacggcgtaacggacctaaaccgtacgttccgtacgtttcctttaccgtacccg

SEQ ID NO: 358005 - DNA, 655 bp, Homo sapiens
  misc_feature: GZ8MTXP02HISPP.25.32.C10.1.454.CMB.2.raw
  modified_base (258)..(258): a, c, t, g, unknown or other
  misc_feature (258)..(258): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccatcctcctgtctgtgtctccgtggggaagcgccacctctcctgcagggccagtcagagtcgttggcaggacttagctggaccngcagaaccgtgccacgccctccagacccttcctcctacgttacgtcggtactcccttacccgaaccggaccggggtccccccttaggaaccttccccgtccccccggtacgtacggtttaccgacgggttacggccgtaggggttcggggtacgtcggggactacgggtacgtttccactcctaccaccgatccgacgtcacgtctcggactagtacgtagtaaagttgttttacgactttagtttacttacgttcgtactaacgtaagtaacttaaactaacggtcgtaccgttcggtaacggttcggttacggacgtaacggggaaacgtagggaaggaaacgtacgaaacgtacgtcggtggactcgaccacgtactcgtcttacttactcccg

SEQ ID NO: 358006 - DNA, 543 bp, Homo sapiens
  misc_feature: GZ8MTXP02FNSE2.25.32.C10.1.454.CMB.2.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (308)..(308): a, c, t, g, unknown or other
  misc_feature (308)..(308): n is a, c, g, or t
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
  modified_base (390)..(390): a, c, t, g, unknown or other
  misc_feature (390)..(390): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccatccctccctgtctgtgtctccgtggggaagngccaccctctcctgcagggccagtcagngcgttggcaggacttagcctggtaccagcagaaacctggccagccctcccagacctcctcctctagtcggtcnccttccgaccacggggccccctgactactccccgctaggttcacgtggcaggtgggtctgggacnggngttcactctcaccntcagcagcctgcagtcngaagtntttgactagtttatactgtaccactagttataactaacgtcggtcctcggtggtacgttcgaccgtaagggaccaagggtagaaacgtacaaacgtactggtcgactgacaacgtatcgtactcttctac

SEQ ID NO: 358007 - DNA, 688 bp, Homo sapiens
  misc_feature: GZ8MTXP02ISR1K.25.32.C10.1.454.CMB.2.raw
  modified_base (233)..(233): a, c, t, g, unknown or other
  misc_feature (233)..(233): n is a, c, g, or t
  modified_base (268)..(268): a, c, t, g, unknown or other
  misc_feature (268)..(268): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctccgtggggaagcgccacctctcctgcgagggccagtcagngcgttggcaggacttgcctggaccagcagaaaccnggccacgccctccagtacctcctcctctagtcggtctcccttcccgaccgacgggccccctagacttaccgtcccccgacgtaacggttcacggtcggaccgtagggttcggggtactaggggaacctaggggtacgtttccaaccttccgtacccaacccgtattccgaacgccgaacgtcccgtcgacgtacgttcgttaaggtaaagtttagttttacgactttaaggtttttaacttacgttacgtacctaacctaagttaaacttaaacgttaaccgttcggtacccgttacgggttacggttacggtttacgggaaccggtaaaacggggtaccgtaaaggggtacggaaaacgtaccgaaaacggtacgtaggtcggacgtaacgactactacgttcgtcgttacttactccg

SEQ ID NO: 358008 - DNA, 685 bp, Homo sapiens
  misc_feature: GZ8MTXP02FV7IN.25.32.C10.1.454.CMB.2.raw
  modified_base (237)..(237): a, c, t, g, unknown or other
  misc_feature (237)..(237): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctcctgtctgtgtctccgtgggggaagcgcccaccctctcctgcgagggccagtcagngcgtggcaggtaacttgcctggaccagcaagaaacctggccacgccctccccagacctccctcctactagtcggtcgtcccttccacccgacgggccccctgactacctcccccgactacggttcacggtcggcgtaggtcggggtgtacggggactaggtacgttccaacgttcctaccaacctagtaccaagcctaacggcccgtgcccgtaagttcgagggtaaactttattttcggacttaagtttttactacgttacgttaccaaacgttaagttaaattaacgtaaacgttcgggtacccttcgggtacggggttaccggtttacgggaaccggtaaaacgggggaacctaaaagggggttacgggaaaacgaaccgaaaacggtaaccgttcggacgggtacctaagaccgtaacctatcgttacgttaccttactaaccg

SEQ ID NO: 358009 - DNA, 560 bp, Homo sapiens
  misc_feature: GZ8MTXP02GTNZE.25.32.C10.1.454.CMB.2.raw
  modified_base (204)..(204): a, c, t, g, unknown or other
  misc_feature (204)..(204): n is a, c, g, or t
  modified_base (362)..(362): a, c, t, g, unknown or other
  misc_feature (362)..(362): n is a, c, g, or t
  modified_base (365)..(365): a, c, t, g, unknown or other
  misc_feature (365)..(365): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctcctggggaagngccaccctctcctgcagggccagtcagagcgttggcaggacttagcctggaccagcagaaacctggccagccctcccagacctcctcctctatcggtgccttccaccgacggcccctgactactccccgcaggttcagtggcaggtgggtctgggacngtntcactctcacatcagcagcctagcagtctagaagtattttgctagtttacttacgtgttacaccgtataattaaataccgttcggacccttccgggtaggtaccgtttacgggaccgaaaggggtacctaaaggggttaggaaaacgacgaaaacgtacgtcggtagactgacccacattcgtatcttctaaccg

SEQ ID NO: 358010 - DNA, 695 bp, Homo sapiens
  misc_feature: GZ8MTXP02IWWYV.25.32.C10.1.454.CMB.2.raw
  modified_base (191)..(191): a, c, t, g, unknown or other
  misc_feature (191)..(191): n is a, c, g, or t
  modified_base (206)..(206): a, c, t, g, unknown or other
  misc_feature (206)..(206): n is a, c, g, or t
  modified_base (306)..(306): a, c, t, g, unknown or other
  misc_feature (306)..(306): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtntctccgtggggaagngcccaccctctcctgcagggccagtcagagcgttggcaggacttagcctggtaccagcaagaaacctggccagccctccagacctcctcctctatggtcnccttccaccgacgggccccctgactactccccgcaggttccaggtcggcaggtcggggtctacggggacacgtcgttacaccttcctaccaaccatcccgaacgccacgcccgttggacctaggttacctaggtaaaaggttcttttaggacttaagttttaacttacgtacgtacctaaccgtaagttaaacttaaacgtaacccgttcggtcccgttacccggggttacgggttaaccggtttacggggaacccgtaaaacgggggtaaccccgtaaaagggggttagggaaaaaccgtaacggaaaaccggtaaaccgttcggggtacggtaacgttcggtaacccgaacccgtagttaccctacggtttcccttaccgttaaccc

SEQ ID NO: 358011 - DNA, 738 bp, Homo sapiens
  misc_feature: GZ8MTXP02H9USR.25.32.C10.1.454.CMB.2.raw
  modified_base (205)..(205): a, c, t, g, unknown or other
  misc_feature (205)..(205): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggcctcccagatgccatggagaaattgtgatgacgcagtctccagcctccctgtctgtgtctcgtgggaagcnccacctctcctgcagggccagtcagagcgttggcaggaacttgctggaccagcaagaaacctggccacgccctaccagtacctcctcctactagtcggtcgtccttacccgaccgaccggggtccccctagtaactacccgtcccccgacgtagggttccacgggtcggcctaggggtcggggttactacggggactaggggtactttaccaaccgtttcgtacccaacccgtatacccgaacgccgaacgtcccgtggacccgtaagttcgtaaggtaaagtttcgttttaggacctttaaggttttaaacctttcgtagttaacccctaacgttaagttaaactaaaccgttaaccgtccgggtaccctttacggggtaggttacccggtttagggaaacccgggtaaaacgggtaaccggtaaaggggtaaacggaaaacgtaaccggaaaacggttaacgtgggttaaccgacgttaaccggaccgtaaacccttgtttaccgtacggtttaaccgtttacccgtaccc

SEQ ID NO: 358012 - DNA, 683 bp, Homo sapiens
  misc_feature: GZ8MTXP02G5J0A.25.32.C10.1.454.CMB.2.raw
  modified_base (237)..(237): a, c, t, g, unknown or other
  misc_feature (237)..(237): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctcctgtctgtgtctccgtgggggaagacgcccaccctctcctgcagggccagtcagngtcgttggcaggacttagcctggtaccagcaagaacctggccacgccctcccagaccctcctcctctagtcggtcgtccttccgaccgacgggtccccctggactacccgtccccgacgtacggtttcacggtcggacgtagggtcgggtcgtacggggactgggtacgtttccaccgttcccacctacacgtacgacgacgaccgtccgtacgtacgtacgttgtaagtacgtttagtttaccgtagtttacgtttactacgttacgtacctaacgttaattaacgttaacgtaccgtccgttaccggttcggttacggttacggttaccggaacgggtaacggtaacggtaacgggtaaaggaaaccgtaaacggtaaaccgtacggtacggtacggttacgaacgtacctacgttacgttcgtccgtttacctactttccccg

SEQ ID NO: 358013 - DNA, 782 bp, Homo sapiens
  misc_feature: GZ8MTXP02I2Y4M.25.32.C10.1.454.CMB.2.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagcgccaccctctcctgcgagggccagtcaggagtcgttggcaaggtactagccgtggtaccagacaagaaacctcggaccacgcccctaccccagtaccctccctacctcttagtggtcctacccttccccgaacccggtaccggggtcccccctagtaaccttaccccgtccccccgacgtacggttccacgggttcggacgtacgggtcggggtcgtaggggaactacgggtacgtttaccaccgttaccctaccaaaccctagttaccaacggcctaaccggtccccgtaggaccgtacggttaccggttacggttaaacggtttatttttacggaccgtttaaaggtttttactttaaccgttacggttaacctaaccgttaaaggtttaacttaaaacgttaaccggtccggttacccgttacggggttacgggttacggttaccgggaaaccggtaaacgggtaaaccgaaagggggtaacggaaaacggtaaaccggtaaaaccggtacgtacgggttacggacgttccggaactacccgtacttacgttccgttacgtttaccctacccg

SEQ ID NO: 358014 - DNA, 559 bp, Homo sapiens
  misc_feature: GZ8MTXP02HRQZY.25.32.C10.1.454.CMB.2.raw
  modified_base (234)..(234): a, c, t, g, unknown or other
  misc_feature (234)..(234): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (356)..(356): a, c, t, g, unknown or other
  misc_feature (356)..(356): n is a, c, g, or t
  modified_base (384)..(384): a, c, t, g, unknown or other
  misc_feature (384)..(384): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggcctcccagatgccatggagaaattgtgatgacgcagtctccagcctcctgtctgtgtctcgtaggggaagacgccacctctcctgcacgggccagtcagngcgtggcaggtactgctgacnanagaacngacagcctccanctcnctntanggtcncctccacgacggccctgactaccgcccgacgtacggtacacggtgcgtggttcgggtcgtgggacngtcgttacactcctacacactcacgacncgctgctagtactagtaattgtttagacttagtttatactgtacagtactaagtaaataaacgtcgtaccgtaagttaggttcggacggtaacgggaccaaagcggttaacgactacgtaacgacggtaaccgtaacggttggcgtcgtaacaccacgttactcgtttacgttcc

SEQ ID NO: 358015 - DNA, 658 bp, Homo sapiens
  misc_feature: GZ8MTXP02HGG7H.25.32.C10.1.454.CMB.2.raw
  modified_base (264)..(264): a, c, t, g, unknown or other
  misc_feature (264)..(264): n is a, c, g, or t
  modified_base (309)..(309): a, c, t, g, unknown or other
  misc_feature (309)..(309): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctccctgtctgtgtctccgtggggaagagcccaccctctcctggcagggccagtcagagcgttggcaggacttagcctggtaccngcagaaacctggaccagccctccgagacctcctcctctatggtcnccttcccaccgtacggggcccccttagaccttaccgtacccccgctacgggtttccacgggtcggtcctagggtcggggtctagggggactagggtacgttccacttcctacaccctatcgacgcacgtcccaggcagtctagaagtatttgacttagtttatcctagtacctacgtagttaataaattaacgtcggtacccgttacggtcgggttacgtttacggaaccggttaaaacgggacccggtaaaggggtagggaaaacgtaacgtaaaaccggtacgttacggtaggtaccctaaggccctaaaccgttacggtccttacggtttaccttaccttaacccg

SEQ ID NO: 358016 - DNA, 604 bp, Homo sapiens
  misc_feature: GZ8MTXP02HZASU.25.32.C10.1.454.CMB.2.raw
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (419)..(419): a, c, t, g, unknown or other
  misc_feature (419)..(419): n is a, c, g, or t
  modified_base (429)..(429): a, c, t, g, unknown or other
  misc_feature (429)..(429): n is a, c, g, or t
tcagactgtacagtcacgaccggtgctcgatttagtatagacatcaacacacaaagggggaggaactgctcagttaggacccagacggaaccatggagccccagcgcagcttctcttcctcctgctactctggctcccagatgccactggagaaattgtgatgacgcagtctccagcctcctgtctgtgtctccgtggggagagccacctctcctgcagggccagtcagagcgttggcaggacttagcctggtaccagcagaaacctggccagccctccagacctcctcctctancggtcnccttcccaccgacgggccccctgactactcccccgacgaggttcacggtcggacgtaggtggggtctggggactagtcgtttcacctcctaccaaccgatcagcacgcctgcacgttntagtaagttntttgacttagttttacttacgttgtactactaagttaattaacgtaacgttcggtaccgttcggtacgggttacggtttacggaaccgtaaagggtaccgtaaagggtaggaaacgaacgtaaaacgacgtcggtacgtacgtaagactaccgtactcgttacgttacttactcg

SEQ ID NO: 358017 - DNA, 630 bp, Homo sapiens
  misc_feature: GZ8MTXP02JZ3LX.25.32.C10.1.454.CMB.2.raw
  modified_base (206)..(206): a, c, t, g, unknown or other
  misc_feature (206)..(206): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagngccaccctctcctgcagggccagtcagagcgttggcaggaacttgcctggaccagcagaaacctggccagccctccagacctcctcctctagtggtcgccttcccaccgacgggcccctgactacgtcccccgctacggttcacggtggcgtaggttcggggtactggggactagggtcgttccacttcgtaccaccatcagcacgcctacgctagtcgtagtaagttatttttgacttaagttttacttacgttgtactaaccgtaagtaattaaacgttaacgtcggtacccgttacggtcggttacggtttacggaccgtaaaacggggtaccggtaaaagggtagggaaaacgtaacgaaacggtaacgtacggtaacggtcgtcgtaccgactacttcgtacgtttacctacgttaccg

SEQ ID NO: 358018 - DNA, 587 bp, Homo sapiens
  misc_feature: GZ8MTXP02HTJVO.25.32.C10.1.454.CMB.2.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (257)..(257): a, c, t, g, unknown or other
  misc_feature (257)..(257): n is a, c, g, or t
  modified_base (267)..(267): a, c, t, g, unknown or other
  misc_feature (267)..(267): n is a, c, g, or t
  modified_base (305)..(305): a, c, t, g, unknown or other
  misc_feature (305)..(305): n is a, c, g, or t
  modified_base (382)..(382): a, c, t, g, unknown or other
  misc_feature (382)..(382): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaaggancccaccctctcctgcagggccagtcagngcgttggcaggactgctgacngcagaaaccngaccagcctaccccagacctcctacctctagtcggtcnccttcccaccgacgggcccctgactacctcccccgacctagggttccaggtggcctagggtggggtcctaggggacngggtatttccacttcctacacccatccagcacgctcgcacgtcgtagtaagtagtttgtcttagtttatttacttgttactaccgtagtaattaattaacgtacgtccgttccggtcggttacggttcggtacgaacggtaaccgaaggtaaggaaacgaacgaaacgaacgtagtaggcgtcgcgacactactcttacttactc

SEQ ID NO: 358019 - DNA, 615 bp, Homo sapiens
  misc_feature: GZ8MTXP02GWL44.25.32.C10.1.454.CMB.2.raw
  modified_base (365)..(365): a, c, t, g, unknown or other
  misc_feature (365)..(365): n is a, c, g, or t
  modified_base (403)..(403): a, c, t, g, unknown or other
  misc_feature (403)..(403): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagacgccaccctctcctgcagggccagtcagagcgtggcaggacttagcctggaccagcagaacctggccagcctcccagacctcctcctctagtcggtgccttccaccgacggcccctgactactccccgctaggttcaggtggctaggtggtctgggacngtgttcactctcacatcagcagctgcagtctagaagtntttgcttagtttacttactgtacctaacgtagttaacttaaacgtaacgtcgggtaccttaccgggtacgggttaccggtttcgggaacccggtaaaacgggggtaaccgaaaggggttaacgggaaaacggaaccgaaaaaccggtaacgttacgggtaacggtcgtaacggacccgtaaccctagttccttcggttacctttactacccg

SEQ ID NO: 358020 - DNA, 602 bp, Homo sapiens
  misc_feature: GZ8MTXP02JQHX8.25.32.C10.1.454.CMB.2.raw
  modified_base (301)..(301): a, c, t, g, unknown or other
  misc_feature (301)..(301): n is a, c, g, or t
tcagactgtacagtcacgaccggtgctcgatttagtatagacatcaacacacaaaggggaggaactgctcagttaggacccagacggaaccatggaagccccagcgcagcttctcttcctcctgctactctggctcccagatgccactggagaaattgtgatgacgcagtctccagcctccctgtctgtgtctcctggggaagagccaccctctcctgcagggccagtcagagcgttggcaggaacttagcctggaccagcagaaacctggccagcctccagacctcctcctctatggtcncctccaccgacggccctgactactccccgctaggttcacggtcggctaggtcgggtctgggacaggtattcaacttcacaaccatcgaagacacgcctcgcagtctagtaagtagtttagtacgtagtttaatttaacttacgtactaacctaacgtaaataaataaacgtacggtaccgtaccgtacggtacggttacggtacgaaacgggtaacggtaaacgggtaaggaaaacggaaacgaaaaccgtaaacgtacgtaggtacgtaacgacaaccactacgtacgttacttactacg

SEQ ID NO: 358021 - DNA, 654 bp, Homo sapiens
  misc_feature: GZ8MTXP02J0GQT.25.32.C10.1.454.CMB.2.raw
  modified_base (372)..(372): a, c, t, g, unknown or other
  misc_feature (372)..(372): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagacgcccaccctctcctgcagggccagtcagagcgttggcaggactagcctggtaccagcagaaacctggccagcctcccagacctcctcctctagtggtcgcttccacgacgggccccctgactacgtcccccgcaggttcacggtggcaggtggggtctggggacnggtagttcactctcacgatcagcagccctggcacgtctaggaagttagttttcgacttaagttttacttacttaggtcctaaccgtaaggttaactttaaattaaacccgtcgggtaacccgttccgggttgggttaccggtttaggggacccgtaaacgggggtaacccgtaaagggggttaacggaaaacgggtaacccgaaaagggtaaaccgttgggttaacgggaccgttcggaccctaaccgtactttccggttacggttacctttccgtaacccg

SEQ ID NO: 358022 - DNA, 669 bp, Homo sapiens
  misc_feature: GZ8MTXP02IBEQ5.25.32.C10.1.454.CMB.2.raw
  modified_base (215)..(215): a, c, t, g, unknown or other
  misc_feature (215)..(215): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccatggagaaattgtgatgacgcagtctccagcctccctgtctgtgtctccgtggggaagcgcccaccctntcctgcagggccagtcagagcgttggcagacttagcctggaccagcagtaaacctggaccagccctcccagacctcctcctctagtggtcgtccttccaccgacgggtcccctgataccgtccccgacgtagggtttccagtcggacctggtcgggtctacggggactgggtacttcacctttccaccaccctatcacgctacgcctagacgtgttacgtagtagtttacgtttcgtactttaagttttacttccgtacgtaacctaactaaagttaacttaacgttaccggtccggtacccgtttacgggttacggttaccgggttacgggaaacccggtaaaacggggtaaccggtaaaggggtaaacggaaaacgtaaacccggaaaacggtcgttacggtacggacgtaaccgtaccacgttacttccgttacgtttcctttaccaccgg

SEQ ID NO: 358023 - DNA, 621 bp, Homo sapiens
  misc_feature: GZ8MTXP02FJ858.25.32.C10.1.454.CMB.2.raw
  modified_base (207)..(207): a, c, t, g, unknown or other
  misc_feature (207)..(207): n is a, c, g, or t
  modified_base (302)..(302): a, c, t, g, unknown or other
  misc_feature (302)..(302): n is a, c, g, or t
tcagactgtacagtcacgaccggtgctcgatttagtatagacatcaacacacaaagggggaggaactgctcagttaggacccagacggaaccatggaagtcccagcgcagcttctcttcctcctgctactctggctcccagatgccactggagaaattgtgatgacgcagtctccagcctcctgtctgtgtctccgtggggaagacncccaccctctcctgcgacgggccagtcagagtcgttggcaggaacttagcctggaccagcaagaacctggccagccctcccagtacctcctcctntagtggtctccttcccaccgacgggcccctagactaccgtcccccgatagggtttccaggtcggccaggttcggggtcctaggggaccaggtacgttcaccttccacacccgtatcagcacgtcctgcagtcagtaagttactttgacttagtttatactcgtactactaagttactaaagtaccgtcgggtacccttcgggttacgggttaccgtttacgggaccggtaaacgggaacctaaaggggtacggaaaacgaccgtaaaacgacgttggtcggtacctcgacctactacttcgtacgttccttacgtaccg

SEQ ID NO: 358024 - DNA, 625 bp, Homo sapiens
  misc_feature: GZ8MTXP02G7HBW.25.32.C10.1.454.CMB.2.raw
  modified_base (337)..(337): a, c, t, g, unknown or other
  misc_feature (337)..(337): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagcgccacctctcctgcagggccagtcagagtcgttggcaggacttgcctggtaccagcagaaacctggaccagccctacccagtaccctcctcctctagtggtctccttcccacgacgggcccctgactcccnccccgacgtacggttcacggtcgctaggtcggtcgtgggactggacgttcactctcacatcagcacgcngcngtctgaattcgttgacttagtttactcgttgacctaactagttaactaacgttaaccgtcggtacccgttcggtacggttaccgggtttacgaaccggtaaacgggtaaccgaaaaggggttacggaaaacgtaccggaaaaacggtacgttacgggttacggaccgtaagtacccaacgttacgttccgttacgtttaccttacggttaaccccg

SEQ ID NO: 358025 - DNA, 675 bp, Homo sapiens
  misc_feature: GZ8MTXP02FOSR8.25.32.C10.1.454.CMB.2.raw
  modified_base (205)..(205): a, c, t, g, unknown or other
  misc_feature (205)..(205): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcgtggggaagngccaccctctcctgcagggccagtcagagcgttggcaggtaactagcctggtaccagcagaaacctggaccagccctccagacctcctcctctatggtcgccttccgaccgacgggccccctggactaccgtcccccgctacggttccaggtcggcctagggtcggggtctcggggactgggtacgttcactctccaccatcagcacgcctgcctagtcgtagtaagtattttcggacttagttttaacttacgtacgtacctaaccgtaagttaaacttaaacgttaacccggtcggtcccgttaccgggttacgggttaccggttttacgggacccggtaaaacgggggtaacccgtaaaagggggttacggaaaaaccggtaaccggaaaacggtaaaccgttggtacgggtaccgtcggaaccctaaccggtactttccgttacggttcccgtttacgttaacccg

SEQ ID NO: 358026 - DNA, 534 bp, Homo sapiens
  misc_feature: GZ8MTXP02IWS59.25.32.C10.1.454.CMB.2.raw
  modified_base (358)..(358): a, c, t, g, unknown or other
  misc_feature (358)..(358): n is a, c, g, or t
  modified_base (392)..(392): a, c, t, g, unknown or other
  misc_feature (392)..(392): n is a, c, g, or t
tcagactgtacagtcacgaccggtgctcgatttagtatagacatcaacacacaaaggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagagcgttggcaggaacttagcctggtaccagcagaaacctggccagcctccagacctcctcctctatgtgccttccaccagggccccctgactactccccgcaggttcagtgcagtggtctgggacngagttcactctcaccatcagcagccctgcagtcngaagtatttgctagtttatactgtcactagtataataacgtgacctcgtgtacgtttaggaccgaagggtaccaagggtaggaaaacgaccgaaaacgtaccgtaggtcggactggactaccatccgtagttcttactaacc

SEQ ID NO: 358027 - DNA, 574 bp, Homo sapiens
  misc_feature: GZ8MTXP02HXOL3.25.32.C10.1.454.CMB.2.raw
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
  modified_base (307)..(307): a, c, t, g, unknown or other
  misc_feature (307)..(307): n is a, c, g, or t
  modified_base (369)..(369): a, c, t, g, unknown or other
  misc_feature (369)..(369): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
tcagactgtacagtcacgaccggtgctcgatttagtatagacatcaacacacaaagggggaggaactactcagttaggacccagacggaaccatggaagccccagcgcagcttctcttcctcctgctactctggctcccagatgccactggagaaattgtgatgacgcagtctccagcctcctgtctgtgtctccgtggggaagngccacctntcctgcagggtccagtcagagtcgttggcaggaacttgcctggtaccagcaagaaacctggccagccctccgagacctccctctctagtggtcnccttccaccgacgggcccctgactactcccccgctaggtcaggtccgcagtgggtctggacngtgttcacgtctcacntcanctagcctgctagtctaggtaattgtttcgacttagtttatactgttcaccgtagtataagtacgtgtccgtcggtcgtaacggttcggaccgtaaacggggaacctaaggggtacgaaacggacgaaaacggaacgtagtacggtacacggcctacgtacttcggtctctttcgtaactttcccg

SEQ ID NO: 358028 - DNA, 493 bp, Homo sapiens
  misc_feature: GZ8MTXP02GO9MQ.25.32.C10.1.454.CMB.2.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (330)..(330): a, c, t, g, unknown or other
  misc_feature (330)..(330): n is a, c, g, or t
  modified_base (358)..(360): a, c, t, g, unknown or other
  misc_feature (358)..(360): n is a, c, g, or t
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
  modified_base (386)..(386): a, c, t, g, unknown or other
  misc_feature (386)..(386): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctccagatgccatggagaaattgtgatgacgcagtctcagcctcctgtctgtgtctccgtggggaagcnccaccctctcctgcagggccagtcagngtcgtggcaggactgctgacngnagacngcagccnccagctccnctctntggtnctccactggccctgacttaccncccgntaggtcagtgcagtggtcnggactgcttcactcacacatcagcagcnnngtntagtagtattntatattattatntactatatataatacgtcgtcgtcgtcgtacgtacgtacgaacggaacgaagaagaaacgaacgaaacgtacgtacgtacgacgaacgacactactactcgtctctc

SEQ ID NO: 358029 - DNA, 636 bp, Homo sapiens
  misc_feature: GZ8MTXP02H4VVK.25.32.C10.1.454.CMB.2.raw
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
  modified_base (310)..(310): a, c, t, g, unknown or other
  misc_feature (310)..(310): n is a, c, g, or t
  modified_base (416)..(416): a, c, t, g, unknown or other
  misc_feature (416)..(416): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctccgtggggaagngccaccctctcctgcgagggccagtcagngtcgttggcaggacttagcctggtaccagcagaaaccgtcggccacgccctcccagacctcccctctctatggtcnccttccacccgcggggccccctgtacctaccgcccccgtactacggttcagtcgggcctagggtcgggtctgggactaggtacgttcacctctcccacagtcagcncgctgacgagttcgtagtaacgttattttagacttagtttaactttacgtacgttaccgaactagtaacttaaacgtaaccttcggtaccttcggttacggtacggtttcggaccggaacgggtaaccgtaaagggtacggaaacggtaaaccgaaacggtaaccgtacgggtcgtacgtaacggacctaccgtaactcgtcggtttacctcttaacccg

SEQ ID NO: 358030 - DNA, 777 bp, Homo sapiens
  misc_feature: GZ8MTXP02I9K55.25.32.C10.1.454.CMB.2.raw
  modified_base (207)..(207): a, c, t, g, unknown or other
  misc_feature (207)..(207): n is a, c, g, or t
  modified_base (759)..(759): a, c, t, g, unknown or other
  misc_feature (759)..(759): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctccgtggggaagacnccacctctcctgcagggccagtcagagtcgtggcaggtactagcctggtaccagcaacgaaaccgtcggaccacgtcccctaccgacgtacccttcccctacctcgttacgtcgggtacctccctttacccgaaccccgaccggggtacccccctaggtaaccttaccccggtaccccccggccgttaacgggtttaccgacggggttcgggtaccggtaaggggttcgggggttccgttagggggaaccctagggggtttacgttacccgtaccttccccgtacccaacccgtaacgttaccgaccgtaccgaaccggtcccgttacggacccgttaagttcggttaaggttaaacggtttctttttacgaccgtttaagttttaaacttaccgttacgttaaccttaaaccggtaagtttaaattaaaaccgtaaccgttccggtacccgttacgggtacggttacggttaccgggaaccgtaaacgggtaaccgtaaagggtacggaaaacgacgaaacggtacgtagtacggtacaacgtcaaccgtntcgtacttctacttaccg

SEQ ID NO: 358031 - DNA, 525 bp, Homo sapiens
  misc_feature: GZ8MTXP02GTM70.25.32.C10.1.454.CMB.2.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (353)..(353): a, c, t, g, unknown or other
  misc_feature (353)..(353): n is a, c, g, or t
  modified_base (388)..(388): a, c, t, g, unknown or other
  misc_feature (388)..(388): n is a, c, g, or t
  modified_base (405)..(405): a, c, t, g, unknown or other
  misc_feature (405)..(405): n is a, c, g, or t
  modified_base (508)..(508): a, c, t, g, unknown or other
  misc_feature (508)..(508): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccatggagaaattgtgatgacgcagtctccagcctccctgtctgtgtctccgtggggaagngtccaccctntcctgcagggccagtcagagcgttggcaggactagcctggtaccagcagaacctggccagcctcccagactcctcctctatgtgccttccaccgacggcccctgactactccccgcagtcagtgcagtggtctggacngagttcactctcaccatcagctagcctagcagtcngagatttgctagttatntcgcactagtataataacgtggcctcgtagtacgtttagaccgaaggggtaccaaagggtcggaaaacgacaaaacggtactacggtaggtcaagacaaccgnttacctgttcttactac

SEQ ID NO: 358032 - DNA, 600 bp, Homo sapiens
  misc_feature: GZ8MTXP02FHG4X.25.32.C10.1.454.CMB.2.raw
  modified_base (206)..(206): a, c, t, g, unknown or other
  misc_feature (206)..(206): n is a, c, g, or t
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (323)..(323): a, c, t, g, unknown or other
  misc_feature (323)..(323): n is a, c, g, or t
  modified_base (455)..(455): a, c, t, g, unknown or other
  misc_feature (455)..(455): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggngccacctctcctgcagggcagtcagagcgttggcaggaacttagctgaccngcagaaacnggcancctccagactcctctctatggtgccttccgaccgagggccccctgacttacncccccgcgtaggttcgaacgttcggcaggtggggtctggggactggacttcactctacaccgattcacgcacgtctgcagtctagagtattttgactagtttattactgtcaccgagttaataaagttaacncgggtcctcggtacggtacgttccgggacccaaagggaaccgtaaagggttaccgggaaaagtaccgaaaacgtaaaccgttggaacggggtccctaagggtacccaaccggtaacgttcccttaaggttcctttacgtaacccg

SEQ ID NO: 358033 - DNA, 697 bp, Homo sapiens
  misc_feature: GZ8MTXP02HX7YF.25.32.C10.1.454.CMB.2.raw
  modified_base (190)..(190): a, c, t, g, unknown or other
  misc_feature (190)..(190): n is a, c, g, or t
  modified_base (230)..(230): a, c, t, g, unknown or other
  misc_feature (230)..(230): n is a, c, g, or t
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
  modified_base (355)..(355): a, c, t, g, unknown or other
  misc_feature (355)..(355): n is a, c, g, or t
  modified_base (412)..(412): a, c, t, g, unknown or other
  misc_feature (412)..(412): n is a, c, g, or t
  modified_base (441)..(441): a, c, t, g, unknown or other
  misc_feature (441)..(441): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgngtcctcgtgggaagacgccacctctctgcaggcagtcagngngtgcaggactagcctggtaccngactagaaacctggcccagccctaccccaggtaccctcctacctcgtagtcggtacgtcccttccccgaaaccgtcggggacccccttggtaaccttaccnccccccgtacgtaacgggttccacggtcgggacctgggttcggggcctggggaaccnggtaagttccaaaccgtcctacaacctcncaaacgtccaaacggttcccacggacgtcgtacgttaacggtaacgtttactttgtacgtttaacgttttacgtaccgttagtaacctaacgttaaagttaacgtaacttaacgtacgtccgttaccggttacggttaccgggtttaccggaaccgggtaaaacggtaacggtaacggtaacggaaaacgaaccgtaaacgtaacgtcggtacgtacgtaacgacctaccgtactcgttacgtttcttaccgtacg

SEQ ID NO: 358034 - DNA, 558 bp, Homo sapiens
  misc_feature: GZ8MTXP01EK6UJ.44.21.B10.1.454.CMB.2.raw
  modified_base (397)..(397): a, c, t, g, unknown or other
  misc_feature (397)..(397): n is a, c, g, or t
  modified_base (412)..(412): a, c, t, g, unknown or other
  misc_feature (412)..(412): n is a, c, g, or t
tcagacagtatatacacgaccggtgctcgatttagtgtcgtcgcaagagaggaggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcacatctcctgcactggaaccacagtgacgtcggtcgttttgaccgtgtctctggtaccagcagacccagaaacacgaccccaaatcattattatgcgtcaatgtcgccctttcgtgtcctgagcgtcttctcgtggtccaagtctggcaacgacgccctccctgaccatctcgtggctccagctgaggacgngctgattatactgcngctcatacgacaagtcggaactacgtttactagttcggcgacgaacggggaaccaaaggccttacggaacccgttccgttaagggttcccacggaaccccgtaaagggcccgttccgcccccgttcgggttcccaaccgtttcccg

SEQ ID NO: 358035 - DNA, 644 bp, Homo sapiens
  misc_feature: GZ8MTXP01E2Y9M.44.21.B10.1.454.CMB.2.raw
  modified_base (207)..(207): a, c, t, g, unknown or other
  misc_feature (207)..(207): n is a, c, g, or t
  modified_base (364)..(364): a, c, t, g, unknown or other
  misc_feature (364)..(364): n is a, c, g, or t
  modified_base (414)..(414): a, c, t, g, unknown or other
  misc_feature (414)..(414): n is a, c, g, or t
  modified_base (516)..(516): a, c, t, g, unknown or other
  misc_feature (516)..(516): n is a, c, g, or t
tcagacagtatatacacgaccggtgctcgatttagtgtcgtcgcaagagagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagactctcctgtgtcgcctctggattcaccatcagtgaccactatatggactgggtccgccaggctccgaggggaaggggctgggagtggcttgggccgacaaagtaaaaacaagttcgccagctttaacncacgagagtaccgccgcgtctgtagaaacgccaagtacttccaccccttntacaaaggacgtaatacggaacctttaacaaagtaaacctctaattcgaactttcaggacggtaaattcggaaacctaaacccgtaaggaaaaaaccccggngggaaccaacggggctaagttggtatttaagtttgtagtttgtacgttttaatagttacgaagggttacttcggtaacccgaacgttcgggggaccaacggggaaccccttggggttcctaaccccgg

SEQ ID NO: 358036 - DNA, 559 bp, Homo sapiens
  misc_feature: GZ8MTXP01EAT87.44.21.B10.1.454.CMB.2.raw
  modified_base (289)..(289): a, c, t, g, unknown or other
  misc_feature (289)..(289): n is a, c, g, or t
tcagacagtatatacacgaccggtgctcgatttagtgtcgtcgcaagagaggaggggggggatctcaggaggcagctctctcggaatatctccaccatggcctgggctctgctcctcctcaccctcctcactcagggcacaggatcctgggcccagtctgccctgactcagcctgcctccgtgtctggttctcctggacagtcgatcaccatctcctgcactgggtccagcaatgacagttgggagatataaccttgtctcctggtatcaacatcatccaaggtaaacncccccaaatcatcatctatgagcctataagacgcctcgtagggtttctaagtcgcttacactcgcctacaacgtccgacaacacggtccctccctgacaatctcgtcgggacctccgaggtctaggacgggacgaggtcgttagggtaatttagtttagttgttgcctgagtattcgtcgtcgctatctactttagtgttcgttacggaaggttcgggacttaacgggtcctaccgtcgttacggacacgtaaccccgaacggaaccccc

SEQ ID NO: 358037 - DNA, 554 bp, Homo sapiens
  misc_feature: GZ8MTXP01DXGWL.44.21.B10.1.454.CMB.2.raw
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
tcagacagtatatacacgaccggtgctcgatttagtgtcgtcgcaagagaggagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctctgcactggaaccacagtgacgtcggtcgtttgaccgtgtctcctggtaccagcacgacccagaaacacgacccccaaatcattattangcgtnatgtcncccttcgtntcctgngcgcttcnctggtcagtctgcaacgcgcctccctgacctatctctgggcctcgaggctggaggacgaggctagtattatactgcaggctacaatactaacgaagtggaaaccttaactttactagttcggaccgcggaaacgggacccaaagtccgttacgacccgttacgttacggccacgtaaccccgaagggccttcggacccccttggtccaaccgttcccg

SEQ ID NO: 358038 - DNA, 589 bp, Homo sapiens
  misc_feature: GZ8MTXP01CVO3D.44.21.B10.1.454.CMB.2.raw
  modified_base (228)..(228): a, c, t, g, unknown or other
  misc_feature (228)..(228): n is a, c, g, or t
  modified_base (424)..(424): a, c, t, g, unknown or other
  misc_feature (424)..(424): n is a, c, g, or t
  modified_base (438)..(438): a, c, t, g, unknown or other
  misc_feature (438)..(438): n is a, c, g, or t
tcagacagtatatacacgaccggtgctcgatttagtgtcgtcgcaagagaggagggggggatctcaggaggcagctctctcggaatatctccaccatggcctgggctctgctcctcctcaccctcctcactcagggcacaggatcctgggctcagtctgccctggctcagcctccctcgtgtccggtctcctggacagtcagtcaccatctctgcactggaaccaacngtgacgtcggtctttgacgtgtctctgtaccagcacgacccagaacacgaccccaatcattattatgcgtacaatcgttcgtccctttcggtcgtccctgacgcgtcttcccgtcgtgggtccaagtcgtaggacaacgaccggtccctccctagaccctatctcgtgggcctcgaggctgaggacgagctgattntactgcaggtctanatataacgaagtacggaacttaactttactagttccggacgcgaacgggaacccaaaggtccttacggaacccgttccgttacggccaaccggtaaccccgaagggtccccttccggcccccccgttcggtcccttaacccgtttccccgg

SEQ ID NO: 358039 - DNA, 714 bp, Homo sapiens
  misc_feature: GZ8MTXP01DJIQZ.44.21.B10.1.454.CMB.2.raw
  modified_base (236)..(236): a, c, t, g, unknown or other
  misc_feature (236)..(236): n is a, c, g, or t
  modified_base (313)..(313): a, c, t, g, unknown or other
  misc_feature (313)..(313): n is a, c, g, or t
tcagacagtatatacacgaccggtgctcgatttagtgtcgtcgcaagagaggaggggggggatctcaggaggcagctctctcggaatatctccaccatggcctgggctctgctcctcctccaccctcctcactcaggcacaggatcctgggctcagtctgccctggctcacgccctccctccgtgtcccgggtctcctggacagtcagtcaccatctcctgcactggaaaccaacngtcgacgttcggttcgttttgaccgtgtctcctggtaccagcacgacccaagaaccacacccccaaatcattattangcgtataatcgttccgtccctttcggtctccgtgacgtcgtcttcccgtcgtcgggtaccaagtccgtacggaccaaccgacccgggtccccttaccccgtacgaacccctacgttcccgttccggtcggggtcccttacccggaagggtccgtagggaacggggtaacggtacgggtccttaggttaaactttaacgttaaccgtcggaccctaaggggtaccctttaacgaaattaaacgtaaacgtaaacgggttacggtaaacctttaacgttttaacgtacgttccgggacgtacggaacgggtaaacccaggtccttacggtacccgttacgttacggccaccggtaaccccgaagggtccctcccggtccccgttacggtcccttcgttccccg

SEQ ID NO: 358040 - DNA, 597 bp, Homo sapiens
  misc_feature: GZ8MTXP01AIVKZ.44.21.B10.1.454.CMB.2.raw
  modified_base (291)..(291): a, c, t, g, unknown or other
  misc_feature (291)..(291): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
tcagacagtatatacacgaccggtgctcgatttagtgtcgtcgcaagagagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtcctgagactctcctgtgtcgcctctggattcaccatcagtgaccactatatggactgggtccnccaggctccgaggggaggggctgggagtggcttgggccgacaagtaaaaacaagttcgaccagtctttaacncanagacgtaccgccgcgtctagagaaacgccagtacttccaccctctacaagagatagacttacgaaacactctattgtacttcgtgacgtaactacgaacctaaaccgtaacgaaaccgacggaaccgaacgggactagttagttaattgtttgttgtttgttagtttagtagtacgttaggttacttcgtccgacggtcgggaccgacggggttaccctcggcctaacccg

SEQ ID NO: 358041 - DNA, 547 bp, Homo sapiens
  misc_feature: GZ8MTXP01A285D.44.21.B10.1.454.CMB.2.raw
  modified_base (301)..(301): a, c, t, g, unknown or other
  misc_feature (301)..(301): n is a, c, g, or t
  modified_base (325)..(325): a, c, t, g, unknown or other
  misc_feature (325)..(325): n is a, c, g, or t
tcagacagtatatacacgaccggtgctcgatttagtgtcgtcgcaagagagagagggggggatctcaggaggcagctctctcggaatatctccaccatggcctgggctctgctcctcctcaccctcctcactcagggcacaggatcctgggctcagtctgccctggctcagcctccctcgtgtccggtctcctggacagtcagtcaccatctcctgcactggaaaccaacagtgacgtcggttcgtttgaccgtgtctctggaccagcagacccagaaacacgaccccaaatcattattangcgtcaatgttcgcccttccggtntccctgacgtcgtccttctcgtgggtccaagtctggcaacatcggccctcctgacccatcctcgtgggcctccgaggctaggaggacgaggctagtattattactggcagctacatataacgaaggtacggaaactactttaactcgttcgggcgtcgacgggacccaaggcttacgaccgttccaggtcacgcccgaaggccttccgccccgttcggtccc

SEQ ID NO: 358042 - DNA, 745 bp, Homo sapiens
  misc_feature: GZ8MTXP01C4I5J.44.21.B10.1.454.CMB.2.raw
  modified_base (289)..(289): a, c, t, g, unknown or other
  misc_feature (289)..(289): n is a, c, g, or t
  modified_base (381)..(381): a, c, t, g, unknown or other
  misc_feature (381)..(381): n is a, c, g, or t
  modified_base (572)..(572): a, c, t, g, unknown or other
  misc_feature (572)..(572): n is a, c, g, or t
  modified_base (645)..(645): a, c, t, g, unknown or other
  misc_feature (645)..(645): n is a, c, g, or t
tcagacagtatatacacgaccggtgctcgatttagtgtcgtcgcaagagagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccggggggagacgttggtccagccgtgggacgggtccccgagactctccgtgtcgtcgcctctggattcaccatcagtcgaccactanatggactgggtccgccgaggcctcgaggggaaggggctggagtggcttgggccgacaaagtaaaaaacaagtttcgacctagtcttttaacnccacaggtacgtaccgccgtacgttactggtaacgaaaacggcccaaaggtactttaccccaaccccttactacgaaagtaagtatacggaacctttaaccgaaaagtaaacccttctaatttgaactttcgtaggaaccgtaaagttacggtaaaacccttaaaacccgtaacgggaaaaaaaccccggngggaaacccgaacggggtacctaagtttaggttaaatttacggtttggttaagttttggtttaacggttttanagtttacggaaaggttaaaccgttcggttaaccccgaacgggttccgggggaacccgaaccgggggtaaccccttggggttaacccaacccgggtttccc

SEQ ID NO: 358043 - DNA, 834 bp, Homo sapiens
  misc_feature: GZ8MTXP01BVZUM.44.21.B10.1.454.CMB.2.raw
  modified_base (435)..(435): a, c, t, g, unknown or other
  misc_feature (435)..(435): n is a, c, g, or t
  modified_base (671)..(671): a, c, t, g, unknown or other
  misc_feature (671)..(671): n is a, c, g, or t
  modified_base (745)..(745): a, c, t, g, unknown or other
  misc_feature (745)..(745): n is a, c, g, or t
tcagacagtatatacacgaccggtgctcgatttagtgtcgtcgcaagagagagcggagccccagccccagaattcccaggtgttttcatttggtgatcagcactgaacacagaggactcaccatggagttcgggctgagcttgggttttccttgttgttattttacaaggtgtccagagtgaagtgctaggttgggtggaggtccgggggagtacgttggtccaggccgtgggacgggtccctggacgtactctcctgtcgtcgcctcgtggattccaccatcgagtcgaccactatagtcggacgtgggtcccgccgaggcctaccggaagggggacgggggcgtagggggacggttcgggtccgtttcggggacccgtaacgtaaaaggttaaaaaaaccgtaaaggttcgacccgtaagttaccttttaacnccgaaacgaggtaccgtacccggccccgtcgttcgtagggtaaacggaaaaccgccctaaaggtacctttccccaaccccttataacgaaagggtacgtacttaacgggtaaaccctttaacggaaaacgttaacccttacgttaagtttacggaaaccttttccgtaacgggtaaccggtaaaaagttcccggtaaaacccttaaaaccccggtaaagggaaaaaaacccccggngggtaaacccgaacggggtacttaaaggtttagtttaactttaaggtttggttacggttttgttaagttttaanacggttacggaaacggttccttcggtaacccggtagggtccggggtaaccccgtacggggttaccccttgggttaacccctaaccccgg

SEQ ID NO: 358044 - DNA, 577 bp, Homo sapiens
  misc_feature: GZ8MTXP01DWGCO.44.21.B10.1.454.CMB.2.raw
  modified_base (232)..(232): a, c, t, g, unknown or other
  misc_feature (232)..(232): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (431)..(431): a, c, t, g, unknown or other
  misc_feature (431)..(431): n is a, c, g, or t
  modified_base (446)..(446): a, c, t, g, unknown or other
  misc_feature (446)..(446): n is a, c, g, or t
  modified_base (567)..(567): a, c, t, g, unknown or other
  misc_feature (567)..(567): n is a, c, g, or t
tcagacagtatatacacgaccggtgctcgatttagtgtcgtcgcaagagaggaggggggggatctcaggaggcagctctctcggaatatctccaccatggcctgggctctgctcctcctcaccctcctcactcagggcacaggatccgtgggctcagtctgccctggctcagcctccctccgtgtccggtctcctggacagtcagtcaccatctcctgcactggaaaccaangtgacgtcggtcgttttgaccgtgtctccgtggtaccagcacgaccccaagaaacacgacccccaaatcaattattangcgtanaatcgttccgccctttcggtcgtccctgacgcgtcttctcgtgggtcctaagtcctcggacaacgaccggtcccctaccctcgacctatctcgtggcctccgaggctgaggacgnggctgattatacgtncgagtctatataactaacgaagtacggaacttacgtttactagttcggacgcgaagggaccaagcttacgaccgttcgttaggttccacgcccgaaggtcctaccgccccgttcggttccnccgtttcccg

SEQ ID NO: 358045 - DNA, 674 bp, Homo sapiens
  misc_feature: GZ8MTXP01CTHEK.44.21.B10.1.454.CMB.2.raw
tcagacagtatatacacgaccggtgctcgatttagtgtcgtcgcaagagagagcggagccccagccccagaattcccaggtgttttcatttggtgatcagcactgaacacagaggactcaccatggagttcgggctgagctgggttttccttgttgttattttacaaggtgtccagagtgaagtgctaggttggtggaggtccgggggatacgttggtccagccgtgggacggtccctgagactctcctgtgtcgcctgtggattccaccatcagtcgacctactatagtggacgtcgggtccgccgaggcctaccggaggggtacgggctgggagtcggcttgggccagtaaagtaaaaactagttcgaccagtctttacgcagagtacgtaccgccgtcgtcgtaggtagaaacgccagtacttccgaccctatacaaaggtagtatacggaaccttacgaaaacgttactcattacgtaatttccgtaggtacgtaaacgttcggtaaacctaaacccggtaacggaaaaaacccgtcgggaaaccgacggggtactaggttagtttaacgttagttggttacgtttgttagtttaatacgtgttaaacgggttcttcggccctacgggtcggggaccgtacggggttaacccctggttaaccctaacccg

SEQ ID NO: 358046 - DNA, 578 bp, Homo sapiens
  misc_feature: GZ8MTXP01DBZTF.44.21.B10.1.454.CMB.2.raw
  modified_base (369)..(369): a, c, t, g, unknown or other
  misc_feature (369)..(369): n is a, c, g, or t
  modified_base (420)..(420): a, c, t, g, unknown or other
  misc_feature (420)..(420): n is a, c, g, or t
  modified_base (456)..(456): a, c, t, g, unknown or other
  misc_feature (456)..(456): n is a, c, g, or t
  modified_base (485)..(485): a, c, t, g, unknown or other
  misc_feature (485)..(485): n is a, c, g, or t
tcagacagtatatacacgaccggtgctcgatttagtgtcgtcgcaagagagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacgttggtccagcctggacgggtccctgagactctcctgtgtcgcctctggattcaccatcagtgaccatatatggactgggtccgccaggcctccgagggaggggctgggagtggcttgggccgacaaagtaaaaaacgaagttcgaccagtcctttaacncacgagacgtaccgcccgtcgtctgtagaaacgccaagtacttccaccctntacgaagagatgaacttagaagtactcattgattcngacgaatcgaaacctaacgagaaaaccgngacacgggctaagttgtattattgtgttgttcgttatatcgttaagttcttcgtccaggtcgggaccacggggttaccctgggaaccctcccg

SEQ ID NO: 358047 - DNA, 554 bp, Homo sapiens
  misc_feature: GZ8MTXP01E1E7R.44.21.B10.1.454.CMB.2.raw
  modified_base (229)..(229): a, c, t, g, unknown or other
  misc_feature (229)..(229): n is a, c, g, or t
  modified_base (328)..(328): a, c, t, g, unknown or other
  misc_feature (328)..(328): n is a, c, g, or t
  modified_base (378)..(378): a, c, t, g, unknown or other
  misc_feature (378)..(378): n is a, c, g, or t
  modified_base (439)..(439): a, c, t, g, unknown or other
  misc_feature (439)..(439): n is a, c, g, or t
  modified_base (531)..(531): a, c, t, g, unknown or other
  misc_feature (531)..(531): n is a, c, g, or t
tcagacagtatatacacgaccggtgctcgatttagtgtcgtcgcaagagaggagggggggatctcaggaggcagctctctcggaatatctccaccatggcctgggctctgctcctcctcaccctcctcactcagggcacaggatcctgggctcagtctgccctggctcagcctccctcgtgtccggtctcctggacagtcagtcaccatctcctgcactggaaccaacngtgacgtcggtcttttgaccgtgtctctggtaccagcacgaccccagaaacacgacccccaaatccattatttatgcggtcaattgtcgcccttcggtntccctgagcgcttcctctggtccagtctaggcaacgcgcctcctgacctntctctcgggctcgaggctggacggacgaggtctaggtattactactgacagggtccttaanactaagtaacgaaggtacggtaaacttacgtttactacgtccggacgcgaacggacaagcgttacgtaccgtcaggttcacgcccgagtccnccgccccttcgtccgttcgtccg

SEQ ID NO: 358048 - DNA, 634 bp, Homo sapiens
  misc_feature: GZ8MTXP01AWJMF.44.21.B10.1.454.CMB.2.raw
  modified_base (257)..(257): a, c, t, g, unknown or other
  misc_feature (257)..(257): n is a, c, g, or t
  modified_base (297)..(297): a, c, t, g, unknown or other
  misc_feature (297)..(297): n is a, c, g, or t
  modified_base (320)..(320): a, c, t, g, unknown or other
  misc_feature (320)..(320): n is a, c, g, or t
  modified_base (364)..(364): a, c, t, g, unknown or other
  misc_feature (364)..(364): n is a, c, g, or t
  modified_base (418)..(418): a, c, t, g, unknown or other
  misc_feature (418)..(418): n is a, c, g, or t
  modified_base (428)..(428): a, c, t, g, unknown or other
  misc_feature (428)..(428): n is a, c, g, or t
  modified_base (486)..(486): a, c, t, g, unknown or other
  misc_feature (486)..(486): n is a, c, g, or t
tcagacagtatatacacgaccggtgctcgatttagtgtcgtcgcaagagagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagacgttggtccagccgtggacgggtccccgagactctcctgtgtcgctntggattcaccatcagtcgaccactatatggactgggtccncgaggcctcgagggagggctggngtggcttggccgacaaagtaaaacgaagttgacctagtctttanccacagacgtacgccgcgtctgtagaaacgccagtcttcgaccctcacaagagntagaccttanaaagactctattagattcgagacgtaagtacgaaacttaaacccgagaaaaacccggnggaaccgtacgggactaagtcgttaatttagttggttgtttaggttactttaagttacgtacgtaagggttaaaccttcggttacccgtaagggtccgggggaacccgtaaaccggggtccccttgggtaaccccttaacggttcccc

SEQ ID NO: 358049 - DNA, 729 bp, Homo sapiens
  misc_feature: GZ8MTXP01DJZT2.44.21.B10.1.454.CMB.2.raw
tcagacagtatatacacgaccggtgctcgatttagtgtcgtcgcaagagagagcggagccccagccccagaattcccaggtgttttcatttggtgatcagcactgaacacagaggactcaccatggagttcgggctgagtccgggttttcttgttgttatttacaaggtgtccagagtagaagtgctaggttgggtggaggtccggggagtacgttggtccagccgtgggacggtccctgacgactctcctgtcgtcgcctcgtggacttcacctatcagtgaccactatatggacgtcgggtccgccaggcctccggaggggaaaggggcgtgggaggtcggtcgttgggacccgacgaaaggttaaaaaaaccgtaaggttacgacccctaaggtcttttaactaccaaccgaaggtacggtaccgccccggtaccgttccgtaagggtagaaaacggcccaagtaccttaccctacccctcgtacaaagtaacggactagtaaccttacgaaaacgtaacttactattgtaactttcctagacgtaagtacgtaaacgttaaaccgtaaacgggaaaaccgacggaacgtacgggaactagttgttattagtttggttgtttggttgttttaaattacgttacgaacggttaaacgttcgttacccgtaacgggtaccggggcgtaaacggggtaccccgttcggtaacccgaacccggtttcccc

SEQ ID NO: 358050 - DNA, 629 bp, Homo sapiens
  misc_feature: GZ8MTXP02J13LY.44.21.B10.1.454.CMB.2.raw
  modified_base (333)..(333): a, c, t, g, unknown or other
  misc_feature (333)..(333): n is a, c, g, or t
  modified_base (360)..(360): a, c, t, g, unknown or other
  misc_feature (360)..(360): n is a, c, g, or t
  modified_base (363)..(363): a, c, t, g, unknown or other
  misc_feature (363)..(363): n is a, c, g, or t
tcagacagtatatacacgaccggtgctcgatttagtgtcgtcgcaagagagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccgaggggaaggggctgggagtggcttgggcccanaagtaaaaacaagttgccagtctttancanagacgtacgccgcgtctagtagaaacgcagtacttaccaccctctacaaagagtatacgtacttacgaaacgtaactactattacgtacttcgtagacgtaatacgtaaacctaaaccgtaacggaaaaccgaggaaccgacgggtactagttagttaattagtttggttagtttaggttagtttaactacgtacgtaacggtaaccttcggtaaccgtacgggtcgggggaccgtaacggggtacccctcgggtaccctacccgg

SEQ ID NO: 358051 - DNA, 604 bp, Homo sapiens
  misc_feature: GZ8MTXP02HFZL8.44.21.B10.1.454.CMB.2.raw
  modified_base (206)..(206): a, c, t, g, unknown or other
  misc_feature (206)..(206): n is a, c, g, or t
  modified_base (253)..(253): a, c, t, g, unknown or other
  misc_feature (253)..(253): n is a, c, g, or t
  modified_base (369)..(369): a, c, t, g, unknown or other
  misc_feature (369)..(369): n is a, c, g, or t
  modified_base (385)..(385): a, c, t, g, unknown or other
  misc_feature (385)..(385): n is a, c, g, or t
  modified_base (476)..(476): a, c, t, g, unknown or other
  misc_feature (476)..(476): n is a, c, g, or t
tcagacagtatatacacgaccggtgctcgatttagtgtcgtcgcaagagagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggganacttggtccagcctgggagggtccctgagactctcctgtgtcgcctntggattcaccatcagtgaccactatatggactgggtccgcaggcctccgaggggaaggggctggagtggcgttgggccgacgaaaggtaaaaaacaaaggttcgaccagtctttancacagacgtacgccgngtctgtagaaagccagattccaccctctacaaagagatgacttacaagaactcattgattctgactaatgaacctaacgtagaaaaaccgnggaacgacgggacagtagtattagtttggtgttttaggttatttaatacgtacgtaaacgggtaacttcggtaaccgtacggttacgggggacccaaggggtaacccccgttggggtaccctacccgg

SEQ ID NO: 358052 - DNA, 537 bp, Homo sapiens
  misc_feature: GZ8MTXP02FKD2T.44.21.B10.1.454.CMB.2.raw
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (327)..(327): a, c, t, g, unknown or other
  misc_feature (327)..(327): n is a, c, g, or t
  modified_base (362)..(362): a, c, t, g, unknown or other
  misc_feature (362)..(362): n is a, c, g, or t
  modified_base (428)..(428): a, c, t, g, unknown or other
  misc_feature (428)..(428): n is a, c, g, or t
tcagacagtatatacacgaccggtgctcgatttagtgtcgtcgcaagagaggaggggggatctcaggaggcagctctctcggaatatctccaccatggcctgggctctgctcctcctcaccctcctcactcagggcacaggatcctgggctcagtctgccctggctcagcctcctccgtgtccgggtctcctggacagtcagtcaccatcctcctgcactggaaccaacagtgacgtcggtcgtttgaccgtgtctcctggtaccagcacgaccccagaaacncgaccccaaatcattattangcgtnaatcgttcgcccttcggtntccctgagcgtcttcctcgtggtcagtctggcacncggcctcctgaccatctctgggctccgagctggagacgagctagtattattactgcagctacatanacaagtaggaactactttactagttcggcgacgacgggaccaaggtctacgacccgtcgtaacgggtcaacggcccgaaaggcctccgcccccttcggcctacttcccg

SEQ ID NO: 358053 - DNA, 637 bp, Homo sapiens
  misc_feature: GZ8MTXP02HGZOD.44.21.B10.1.454.CMB.2.raw
tcagacagtatatacacgaccggtgctcgatttagtgtcgtcgcaagagagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggacttcaccatcagtgaccactatatggactcggtccgccaggctccgaggggaacggggctggagtggcgttggccgacgaagtaaaaacaagttcgaccagtcttatcacgagagtacgccgcgtctggtagaaacgtccaagtacttaccaccctctacaaagagatagaccttacaacgaactctaattgtaattctgaccgaaattacgaaacctaaaccgttaacgaaaacccggtaggaaaccgggaacgggactaaggttgttaaagtttagtttggttgtttaggtttagtttactagtaccgtaaggtaacttacggtccgaacggttcgggggacccgtaacgggaacccgttcggtaccgttaaccccg

SEQ ID NO: 358054 - DNA, 677 bp, Homo sapiens
  misc_feature: GZ8MTXP02I9YOR.44.21.B10.1.454.CMB.2.raw
  modified_base (206)..(206): a, c, t, g, unknown or other
  misc_feature (206)..(206): n is a, c, g, or t
  modified_base (332)..(332): a, c, t, g, unknown or other
  misc_feature (332)..(332): n is a, c, g, or t
  modified_base (520)..(520): a, c, t, g, unknown or other
  misc_feature (520)..(520): n is a, c, g, or t
tcagacagtatatacacgaccggtgctcgatttagtgtcgtcgcaagagagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccggggganacttggtccagcctggagggtccctgagactctctgtgtcgcctctggattcaccatcagtcgaccactatatggactgggtccgcgaggcctccgaggggaaggggctggagtggcttggccganaagtaaaaacaagttgacctagtcttactcacagacgtacgccgcgtctgtagaaacgccaagtactttccacccttactacgaaacgagtatcggtaaacttacaaaacggtaaactctaatttagaactttcgagtaaccggtaaattacggaaacccttaaaccgtaaacggaaaaaaccccggngggaacccgtaacggggacctaagttaggttaaatttaagttttcgggttagttttaggttaccgtttaaataacgttacgtaaacgggtaaccttggtaacccaacgggttcgggggaccctaacggggtaacccccgtgggtacccctaacccgg

SEQ ID NO: 358055 - DNA, 647 bp, Homo sapiens
  misc_feature: GZ8MTXP02G47L4.44.21.B10.1.454.CMB.2.raw
  modified_base (293)..(293): a, c, t, g, unknown or other
  misc_feature (293)..(293): n is a, c, g, or t
  modified_base (364)..(364): a, c, t, g, unknown or other
  misc_feature (364)..(364): n is a, c, g, or t
tcagacagtatatacacgaccggtgctcgatttagtgtcgtcgcaagagagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggacggtccctgacgactctcctgtgtcgcctctggattcaccatcagtgaccactatatggactggtccncaggcctccgagggaggggctggagtggcttggccgacaaaggtaaaaacaaggttcgaccagtctttacncacgagacgtaccgccgtcgtctggtagaaacgtccagtacttccaccctctacgaaagacgagtacgaaccttacaaacgtaactactagttagtactttccgagaccgtaaatcgaaaccttaaaccgtaaacggaaaaacccggaggaaccgaacggggacagttagtaatttagttagttgtttagttagtttaatacttacgacggttaacttcggtaaccgtaacgggttcgggggaaccctaacggggtaaccccgttcggtacccgtaaccccgg

SEQ ID NO: 358056 - DNA, 685 bp, Homo sapiens
  misc_feature: GZ8MTXP02JCTIQ.44.21.B10.1.454.CMB.2.raw
  modified_base (377)..(377): a, c, t, g, unknown or other
  misc_feature (377)..(377): n is a, c, g, or t
  modified_base (453)..(453): a, c, t, g, unknown or other
  misc_feature (453)..(453): n is a, c, g, or t
tcagacagtatatacacgaccggtgctcgatttagtgtcgtcgcaagagagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagccgtgggacgggtccccgagactctcctgtgtcgcctctggattcaccatcagtgaccactatatggactgggtcccgccaggcctccgaggggaaggggctggaggtggcttcgggccgacgaaaggtaaaaacaagttcgaccgtagtacttttancccgacagtacgtaccgccgacgttctggtacgaaagcccagtacttccaccctctacaagagatagtaaccttanaaacgacctactaattcgactttcgtacggactaaagtacgtaaaacctaaaccgtaaacggaaaaacccggacgggaaacccgaaccgggggtactaagttagtttaaagtttagttgggtttagttttaggtttagtttaaacgtatacggtaacggtaactcgtaacccgcgggttacgggggacccgttaacggggtaaccccgttcggtaaccgtacccggttcccg

SEQ ID NO: 358057 - DNA, 635 bp, Homo sapiens
  misc_feature: GZ8MTXP02F5GRK.44.21.B10.1.454.CMB.2.raw
  modified_base (359)..(359): a, c, t, g, unknown or other
  misc_feature (359)..(359): n is a, c, g, or t
  modified_base (501)..(501): a, c, t, g, unknown or other
  misc_feature (501)..(501): n is a, c, g, or t
tcagacagtatatacacgaccggtgctcgatttagtgtcgtcgcaagagagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggaggtccctgagactctcctgtgtcgcctctggattcaccatcagtcgaccactatatggactggtccgccaggctccgagggaaggggctggagtggcttggccgacaagtaaaaacaagttgaccagctttacncacagagtacgccgcgtctgtagaaacgccagtactccaccctctacgaaacgagaactgaacctttacgaaacgtaacctacgtaattagactttcgtagacgtaaatcgtaaaacccttaaccgtaaggaaaaaccccgnggaaccgacgggactaagttacggttaatttagtttggtaggtttagttagttttaaatactacgtaaacgggacttacgtcccgtaacggtcggggacccgtacggggtaaccctcggtacccgtaaccccgg

SEQ ID NO: 358058 - DNA, 601 bp, Homo sapiens
  misc_feature: GZ8MTXP01EOVDS.3.53.E09.1.454.CMB.2.raw
  modified_base (243)..(243): a, c, t, g, unknown or other
  misc_feature (243)..(243): n is a, c, g, or t
  modified_base (296)..(296): a, c, t, g, unknown or other
  misc_feature (296)..(296): n is a, c, g, or t
  modified_base (329)..(329): a, c, t, g, unknown or other
  misc_feature (329)..(329): n is a, c, g, or t
  modified_base (366)..(366): a, c, t, g, unknown or other
  misc_feature (366)..(366): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
tcagagacgcactccacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtctccagactccctggctgtgtctcgtgggcgagacggccaccatcaactgacaagtccagccagtagttgtttanacagctaccaaacaaaagtactacgttaggtacggtaacagacaagaaaccgngggcacgccctactaagctgctacacttaccgnggcacgtccgtaccggatcgtcgggtcctcgaccgtntcgagtcgacgaggcgggtctgggacagtacttcnctcncacatccacacctgacaggctaggaaagtgttcggtacggttacccgttttaataccttggtacagtactaaattagttagtcggtacctccgtaccggtaggtaccgttaacggaccgttaaaggggaccttaaagggtaggtaaacttaacgaaacgttaacgtggtcggcttcggaccacgtaattccgttcg

SEQ ID NO: 358059 - DNA, 630 bp, Homo sapiens
  misc_feature: GZ8MTXP01A38TC.3.53.E09.1.454.CMB.2.raw
  modified_base (244)..(244): a, c, t, g, unknown or other
  misc_feature (244)..(244): n is a, c, g, or t
tcagagacgcactccacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgagacggccaccatcaactgacaagtccagccagtagttgtttanacagctaccaaacaaaagactacgttaggtgaaccagacaagaaccgaggcacgcctacctaagctgctacacttaccgtggactactccgtacccggaatccgtcggggtccctggaccgtattcgaggtcggacgagggtccgggtcgtaggggaccagtactttcactcctacacctatcccaaccaacgtgacgaggtctaggaaagtagttcgggtacggttacccttttattaccgtgtaccaagtactaaattattagttccggtaccttcccgtacggtcggtaaccggttcgaaccggaaagggtacccaaaggggtacaaaacttaccgaaaacgttacgttggcggtcctacggaccttaaccgtgttccgttcg

SEQ ID NO: 358060 - DNA, 635 bp, Homo sapiens
  misc_feature: GZ8MTXP01DWJRR.3.53.E09.1.454.CMB.2.raw
  modified_base (243)..(243): a, c, t, g, unknown or other
  misc_feature (243)..(243): n is a, c, g, or t
  modified_base (351)..(351): a, c, t, g, unknown or other
  misc_feature (351)..(351): n is a, c, g, or t
  modified_base (595)..(595): a, c, t, g, unknown or other
  misc_feature (595)..(595): n is a, c, g, or t
tcagagacgcactccacgaccggtgctcgatttagagagagtgtgttgggttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgaggacggccacatcaactgacaagtccagccagtagttgtttanacacgacctaaccaaaacaaaaaacgtaactaacgttaagggtacggtaaccagacaaacggaaaccgagggacacgccctacctaacgctgcctactaacttaccgngggtacctacgtaccgtaacccgggtaatccggtcggggtccctacggaccgtatcgaggtcggacgcgggcgggtcgtagggactagtacttcactctacacataccaactacctgacagactaggaaagtcgtggttacgttaccgtttaattacgtgtactaagtaactaaattagttagtaccggtactcccgtacggtgggtaccgttcggacgaaagggtaccgaaaggtaacgtaanaaccgaacgttaacgtgagtctaagccttactgttcgttc

SEQ ID NO: 358061 - DNA, 677 bp, Homo sapiens
  misc_feature: GZ8MTXP01AH8T5.3.53.E09.1.454.CMB.2.raw
  modified_base (244)..(244): a, c, t, g, unknown or other
  misc_feature (244)..(244): n is a, c, g, or t
  modified_base (341)..(341): a, c, t, g, unknown or other
  misc_feature (341)..(341): n is a, c, g, or t
  modified_base (472)..(472): a, c, t, g, unknown or other
  misc_feature (472)..(472): n is a, c, g, or t
tcagagacgcactccacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgagacggccaccatcaactgacaagtccagccagtagttgttttanacagacctaccaaaacaaaaagaacttacgttaaggtacggtaaccagacaacgaaaccgagggacacgtccctacctaagctgcctcaattaccgnggacacgtccgtaacccggggaacttccggtcggggtacccctacggacccgtagttccgaggtcggacgacgggtcgggtcgtagggactagtactttcacttcctcaacctacgtaccaaacccgaccncgaccgaggtactaggaacgtcgttcggttacggttacctttaagttacgtgtaccgaagtaacttaagttagtttacggtaccggttacccttccggttaccggttacggaccggttaaccggaaccggaaagggtaccgttaaagggtaaacgaaacgttacgaaacgttacgtggtacgccgtagaccactaacgttcgtcg

SEQ ID NO: 358062 - DNA, 687 bp, Homo sapiens
  misc_feature: GZ8MTXP01EP84W.3.53.E09.1.454.CMB.2.raw
  modified_base (235)..(235): a, c, t, g, unknown or other
  misc_feature (235)..(235): n is a, c, g, or t
tcagagacgcactccacgaccggtgctcgatttagagagagtgtgttgggtttgggggttattcgacttttcacagatactgcatattcattataccacttggacctgtagaatgtccttcccctctcactcacctgtgccatctccggggacagtgtcgctagttacagtgctgtttggaactggatcaggcacgtccccatcgagaggccttgagtggctgggaaggctttanacaagtccaagtgggaacatcaattatgcagaatctgagaaaagtcgaagtaatcatacgaacgccgaacacactccgaaggaacctacgttcctcccgtagacctaaacgtgaaagttctaggtacgaaccccgtcccggaaggaccgacggtctttaagtttaacttaacgtgtacgactaaggacggacgggagggacgggaagtacgtaggttttacggacgacggtacggttacgggggaccggtaaccggggtaacccgttcgggtacccgtaacccggtccttcccgtacgacgtaccccttacccgaaccggtaaccggaccccgtacgttccggtacccccgttccccgtcgggcccctcccgtcgcctccgacggaccgccgtacccgccggaagccgacgaaccgacggtcccggccggtcggcgtaacgccgtaaccggg

SEQ ID NO: 358063 - DNA, 688 bp, Homo sapiens
  misc_feature: GZ8MTXP01CWPEU.3.53.E09.1.454.CMB.2.raw
  modified_base (239)..(239): a, c, t, g, unknown or other
  misc_feature (239)..(239): n is a, c, g, or t
  modified_base (285)..(285): a, c, t, g, unknown or other
  misc_feature (285)..(285): n is a, c, g, or t
  modified_base (314)..(314): a, c, t, g, unknown or other
  misc_feature (314)..(314): n is a, c, g, or t
  modified_base (412)..(412): a, c, t, g, unknown or other
  misc_feature (412)..(412): n is a, c, g, or t
tcagagacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagaggccacatcaactgacaagtccagccagtagttgtttanacagctaccaaacaaaagactacttaggtgtacagcaagaaaccgnggcagcctactaagctgctcaattaccgnggacctagtccgtacccgggaattccgtcgggggtcccctaggaccgtattcgacgtggacctagggcggggtctagggaactaggtactttcactcncaaccactaccaccctaacgtcgacgacggtcaaggtaacgtacgtcggttaccggttacccgttttaagtttaaacccgttgggttaaccaacggttaacctaaagtttacgtttacggttaacggttacccttcccgggtaccggttacggggtacccggtttaaccgggaaaccgaaacgggggtaacccgttaaaggggttaaacggaaacgttaaaccggaaacgttaacgtcgggtacgtccgtacggaccttacgtaacgttctttccg

SEQ ID NO: 358064 - DNA, 784 bp, Homo sapiens
  misc_feature: GZ8MTXP01BC36U.3.53.E09.1.454.CMB.2.raw
  modified_base (251)..(251): a, c, t, g, unknown or other
  misc_feature (251)..(251): n is a, c, g, or t
  modified_base (314)..(314): a, c, t, g, unknown or other
  misc_feature (314)..(314): n is a, c, g, or t
tcagagacgcactccacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgaggacgggccaaccatacaactgacaacgtccagccagtagttagttttanacagacctaaccaaaacaaaaagtaacttaacgttagggtacgtaaccagacaacgaaaccgngggaccacgaccctacgtaagctcgctactaacttaccggtagggacctacgttacccggtaaccccggggtaaacttccgggttaccgggggtccccctacggtaaccccggtagtttaccggaagggttcgggaaccgacgggtccggggttcgtacgggggaactacggttactttccaccttccctaccaacccgtactaccccaaacccgtaaaccgttcggaacccgtacgggtaccttagggaaagttacgttcgggttacggtttacccgttttaaggttaccgtttacggtaccaaggttaaccttaaatttacgtttacggtaccggtttaacccttcccggttaccgggttacggggtaccggttaaccgggaacggttaaacggggtaacttaaacggggtaagtaaacttacggaaacgttcgtggtcggtctcgacttaccgtaattccgttaacg

SEQ ID NO: 358065 - DNA, 693 bp, Homo sapiens
  misc_feature: GZ8MTXP01CH693.3.53.E09.1.454.CMB.2.raw
  modified_base (247)..(247): a, c, t, g, unknown or other
  misc_feature (247)..(247): n is a, c, g, or t
  modified_base (308)..(308): a, c, t, g, unknown or other
  misc_feature (308)..(308): n is a, c, g, or t
  modified_base (338)..(338): a, c, t, g, unknown or other
  misc_feature (338)..(338): n is a, c, g, or t
  modified_base (382)..(382): a, c, t, g, unknown or other
  misc_feature (382)..(382): n is a, c, g, or t
  modified_base (404)..(404): a, c, t, g, unknown or other
  misc_feature (404)..(404): n is a, c, g, or t
tcagagacgcactccacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgaccagtctccagacctcccgtggctgtgtctcgtgggcgagacggccacatcaactgacaacgtccagccaagtagttagtttaanacacgtacctaaccaaaacaaaaagtaacttacgttaggtacgaaccagacaaagaaccgnggcacgtcctaccagctgctactattccgnggctagtccgtaccggatccgtcgggtccacggtacctgtacgngtcggacgacgggtcggggtancggggaaactgttacgttcccaacttcctaacctaccctaagtacccaaaccctaaccgttggaccgtacgggacctaggaaagtcgtggttacgtttaccgtttaacgtcgttcggtaaccagtacctaaagttaccgtttagttccggttacctccggttaccgggtacggtaccggttaacccgggaaccgttaaacggggtaacccgttaagggtaaacgtaacgttaaaccgaaacggttacggtggtaacggtcctacggtacccaacttcgttccgtttccg

SEQ ID NO: 358066 - DNA, 613 bp, Homo sapiens
  misc_feature: GZ8MTXP02I29O4.3.53.E09.1.454.CMB.2.raw
  modified_base (238)..(238): a, c, t, g, unknown or other
  misc_feature (238)..(238): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
tcagagacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgttttanacagcctaccaaaacaaaaagaactacttaggttggtaccagacaagaaaccagggcagcctacctaagctgcctcattaccgtggctatccgtacccgggaatccgtggggtccctcgaccgattcagtgcagcgggtcngggacagtnttcactctcaccatccaaccaactgacaggctaggaacgtagtaggttcggtacccttttaagttactggtaccaggtacctaaattagtttagtcggttaaccttcccgttaccggtaggtaccgttaccggaccgtaaaacggggacctaaagggtacggaaaacgtaaccgaaaaccggtaacgtggtacggaccgtcgacctaccctaatttccgtttacg

SEQ ID NO: 358067 - DNA, 555 bp, Homo sapiens
  misc_feature: GZ8MTXP02JXZ6R.3.53.E09.1.454.CMB.2.raw
tcagagacgcactccacgaccggtgctcgatttagagagagtgtgttgggtttggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagtccagccagagttgtttatacagctaccaaacaaaagactacttaggtgtaccagcagaaaccaggcagcctcctaagctgctcattacctgggcatcctaccgggatcgtcggggtccctgaccgattcagtggcaggcgggtctgggacagattcactctcaccatccaccactgacaggctagaacgatggtacggtaccgtttatacctgtacagtctaaattacttagtcggtacctccgttccggtaggaaccgtttcggaccgtaaggggacctaaagggtacgaaaactacgaaaacgacgtgtacggctacggacacctatctacg

SEQ ID NO: 358068 - DNA, 660 bp, Homo sapiens
  misc_feature: GZ8MTXP02IPYS2.3.53.E09.1.454.CMB.2.raw
  modified_base (239)..(239): a, c, t, g, unknown or other
  misc_feature (239)..(239): n is a, c, g, or t
  modified_base (310)..(310): a, c, t, g, unknown or other
  misc_feature (310)..(310): n is a, c, g, or t
  modified_base (342)..(342): a, c, t, g, unknown or other
  misc_feature (342)..(342): n is a, c, g, or t
tcagagacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttttanacagctaccaaacaaaagactactagtgtaccagcaagaaacaggcagcctacaagctgctacacttaccnggcatccgtacccgggaatcgtcggggtcccngacccgtattcagtgcgagcgggtctgggacagtactttcacttctaccaactactacccaacccaacctgaccagggtctaagaaacgtagtcggttacggtacccgtttttaaataccgttgtaccagtaactaaatttagttaagttcggtaaccttcccgtaccgggttacgggaacccggtttacgggacccgtaaaacgggggtaacccgtaaaaggggttaacgggtaaaaacctaaccggtaaaaacggtaaaccgttggggtaacgggtaccctacgggaaccctaccctaaaggtttcctttaaccgg

SEQ ID NO: 358069 - DNA, 495 bp, Homo sapiens
  misc_feature: GZ8MTXP02IH6LB.3.53.E09.1.454.CMB.2.raw
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (303)..(303): a, c, t, g, unknown or other
  misc_feature (303)..(303): n is a, c, g, or t
  modified_base (349)..(349): a, c, t, g, unknown or other
  misc_feature (349)..(349): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (464)..(464): a, c, t, g, unknown or other
  misc_feature (464)..(464): n is a, c, g, or t
  modified_base (488)..(488): a, c, t, g, unknown or other
  misc_feature (488)..(488): n is a, c, g, or t
tcagagacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctacaaanaaaagactactaggtgtaccagcagaaaccaggcagcctcagctgctcatacnggcatcaccggatcgtgggtcctgaccgattcagtgcagcgggttngggacagtacttcgactctcacatccaaccaactgacacggctagaaagatgtggtacctttatactgtacagtacaatntatgtacnctcgtgacttcggcaaagggcaagganaacacaaacgatgtagctgacacngtactcg

SEQ ID NO: 358070 - DNA, 519 bp, Homo sapiens
  misc_feature: GZ8MTXP02FH7DI.3.53.E09.1.454.CMB.2.raw
tcagagacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctccaaacaaaagaactacttaggtgtaccagcagaaaccagggcagcctcctaagctgctcattacctggcatctacccgggaatctggggtcctgaccgatcagtgcagcgggctgggacagatttcactctcaccatcaccaacctgcaggctgaagatgtggccgtttaattactgtccagcaatattatggtactcctcgtggacgttcggccaaagggaccaaaggtcggaaaactacgaaacgaaactggtacggctacgccaccatctcg

SEQ ID NO: 358071 - DNA, 625 bp, Homo sapiens
  misc_feature: GZ8MTXP02F5M3I.3.53.E09.1.454.CMB.2.raw
  modified_base (240)..(240): a, c, t, g, unknown or other
  misc_feature (240)..(240): n is a, c, g, or t
  modified_base (312)..(312): a, c, t, g, unknown or other
  misc_feature (312)..(312): n is a, c, g, or t
tcagagacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagtccagccagagttgtttanacagctaccaaacaaaagactacttaggtgtaccagcagaaaccaggcacgcctacaagctgctcataccgnggcatcgtacccggaatccgtcggggtccctgaccgtattcgaggtcggcagggtcggggtctaggggactagtactttcacttctacaccctatccaaccctaactgacaggctagaagtagtggttacggtacctttaataccgtgtacaagtactaaagttagttacgtcggttaacctcccgttaccggggtggtaacccggtttcgggaaccggtaaacggggacccgtaaaaggggtacggtaaaacttaccggaaaacgtaacgtggtacggtaccgtacggaccctaaaccgtacttccgttacg

SEQ ID NO: 358072 - DNA, 564 bp, Homo sapiens
  misc_feature: GZ8MTXP02HFJYQ.3.53.E09.1.454.CMB.2.raw
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
  modified_base (462)..(462): a, c, t, g, unknown or other
  misc_feature (462)..(462): n is a, c, g, or t
tcagagacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttttanacagctacaaacaaaagaactacttaggtgtacagcaagaaaccaggcagcctacaagctgctacattaccgnggcatccgtacccgggaatccgtacggggtccctagaccgtattcagtggcaggcggggtctgggacagtacttcactcacacactccaccaactgacagctaagaagtagtcggtacggtccttttaatacgtgtacagtactaaattnttagtcggtactcccgtcggtacgtaccgttacggacgaaacgggtccaaagggtacgaaaactaccgaaacgacgtgtacggctacgaccactactctacg

SEQ ID NO: 358073 - DNA, 576 bp, Homo sapiens
  misc_feature: GZ8MTXP02JL2LK.3.53.E09.1.454.CMB.2.raw
  modified_base (239)..(239): a, c, t, g, unknown or other
  misc_feature (239)..(239): n is a, c, g, or t
  modified_base (285)..(285): a, c, t, g, unknown or other
  misc_feature (285)..(285): n is a, c, g, or t
  modified_base (313)..(313): a, c, t, g, unknown or other
  misc_feature (313)..(313): n is a, c, g, or t
  modified_base (422)..(422): a, c, t, g, unknown or other
  misc_feature (422)..(422): n is a, c, g, or t
tcagagacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagctaccaaacaaaagaactacttaggtgtaccagcagaaaccnggcagcctactaagctgctcattaccgngggcatccgtaacccggatccgtcggggtcctcgaccgtattcgagtggcaggcgggtctggggacagtatttcactctacacctatccaaccactgcaggctagaagnttggtcgtccgtttaataccgtgtaccagactaaagttattacgtcggtaccttcccgtcggtaggtaccggttcggacgtaaacgggaaccgaagggttagaaaactaccgaaaacgtaagtggtacggtactacgacctaccattccgttag

SEQ ID NO: 358074 - DNA, 616 bp, Homo sapiens
  misc_feature: GZ8MTXP02HYREI.3.53.E09.1.454.CMB.2.raw
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
  modified_base (292)..(292): a, c, t, g, unknown or other
  misc_feature (292)..(292): n is a, c, g, or t
  modified_base (325)..(325): a, c, t, g, unknown or other
  misc_feature (325)..(325): n is a, c, g, or t
  modified_base (451)..(451): a, c, t, g, unknown or other
  misc_feature (451)..(451): n is a, c, g, or t
  modified_base (463)..(463): a, c, t, g, unknown or other
  misc_feature (463)..(463): n is a, c, g, or t
tcagagacgcactccacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtctccagacctcctggctgtgtctcgtgggcgagacgggccaccatcaactgacaagtccagccagtagttgttttanacagctaaccaaaanaaaagtactacgtaggtgacagacaagaacgnggcagcctacgtaagctcgctactacttaccgnggactacgtaccgtaacccgggattcggtaccgggtccacggaaccgtacttcgaggtcggacgcgggtccgggttcgaggactagttactttacaccttacaccaacaactcccaaaccctacgngaacgacggtanaaggagtgttacggtacgtttactttatcgtcgacatataattatacgtacgtacctccggttacgtacggtaccggtacggaaccggtaaacggaacgaaggtaacgaaacaccgaaaacgtgtcgacgtacacgacctactcgtttactcg

SEQ ID NO: 358075 - DNA, 634 bp, Homo sapiens
  misc_feature: GZ8MTXP02JCW2E.3.53.E09.1.454.CMB.2.raw
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
  modified_base (316)..(316): a, c, t, g, unknown or other
  misc_feature (316)..(316): n is a, c, g, or t
tcagagacgcactccacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgaggagggccaccatcaactgcaagtccagccagagttgtttanacagctacaaanaaaagactactaggtgtacagcaagaaaccagggcacgcctacctaagctgctcattaccgnggacatccgtaacccgggatccgtcggggtccctgacccgtattcgagtggcgaggccggggtctaggggacctagtactttccaacgttcctaccaacctactacccaaaccctaaaccgttggacccaggggtcctaggaaaagtcgttaggttacgggtacctttttaatacgttggacctagacttaaattgttaagtcggtaacccttccgtacgggttacggtacccggtttacggacccgtaaaggggaccgtaaagggttacgaaacgttacgaaacgtaacgtggtacgctacgacaccgtatccgttg

SEQ ID NO: 358076 - DNA, 612 bp, Homo sapiens
  misc_feature: GZ8MTXP02GY55A.3.53.E09.1.454.CMB.2.raw
  modified_base (242)..(242): a, c, t, g, unknown or other
  misc_feature (242)..(242): n is a, c, g, or t
  modified_base (290)..(290): a, c, t, g, unknown or other
  misc_feature (290)..(290): n is a, c, g, or t
  modified_base (318)..(318): a, c, t, g, unknown or other
  misc_feature (318)..(318): n is a, c, g, or t
tcagagacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggagggccaccatcaactgacaagtccagccagagttgtttanacagctaccaaaacaaaagactacgttaggtgtaccagcaagaaaccnggcagcctactaagctgctcattaccgnggcagtccgtacccgggaatcggtcggggtccctagaccgtattcaggtggccgaggcggggtctaggggactagtactttcgactcctacaccctatacccaacccgtaacctggacacgggtctaaggaaacgtagttcgggttacggtacccgtttttataaccgtgtacagactaaaagttacttagtacggtaccttccgtaccggtagggtaccttcggaccgtaaaggggaccaaggggttacgaaacaccgaaaacgtctggtcgactcgactaccgtattcgtcg

SEQ ID NO: 358077 - DNA, 663 bp, Homo sapiens
  misc_feature: GZ8MTXP02JV8JF.3.53.E09.1.454.CMB.2.raw
  modified_base (338)..(338): a, c, t, g, unknown or other
  misc_feature (338)..(338): n is a, c, g, or t
  modified_base (376)..(376): a, c, t, g, unknown or other
  misc_feature (376)..(376): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (406)..(406): a, c, t, g, unknown or other
  misc_feature (406)..(406): n is a, c, g, or t
tcagagacgcactccacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgaggacgggccacatcaactgacaagtccagccagtagttgtttacacagacctaacaaaacaaaaacgtactacgttaaggtcgtaaccagacgaacgaaacgagggacacgacctactaagctacgctactatccgnggactacgtcgtaaccggatcggtcggtccacgacgtntcgaggngacncggcggtgagggactagtnttcacttccactaacctatacccgaacctacgtgacgtagggtctaaagaaacgtgttacggttacgggttaccttttaaagtccgtagtctaacgttaataatttagttaccggttacggttaacccttcccgggtagtaacccgggttaacgggttcccggaaaacgggtaccgggaaccggttaaaggggaaacgttaaacaaacgtaaaaccggtgtcggtacgacgttacaccgtaaccgttctcgttaccg

SEQ ID NO: 358078 - DNA, 692 bp, Homo sapiens
  misc_feature: GZ8MTXP02IPWRH.3.53.E09.1.454.CMB.2.raw
  modified_base (504)..(504): a, c, t, g, unknown or other
  misc_feature (504)..(504): n is a, c, g, or t
tcagagacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggagggccaccatccaactgcaagtccagccagtagttgttttatacagtcctaccaaaacaaaaagtaacttaacgttaggttaggtaaccagacaacgaaaaccccgaggggtaccacgccccttacctaaagtcctcgcctactagtttacccgtgggctaacgtccggtaaccccgggaatccggtacggggtcccctaggacccgtaattcgaaggtcgggaccagggtccggggtctacgggactacgtactttacacttccactacccatccaaacccactggactggctagaaagtntgttacggtccttttaaagcttgtaccaatacgtaaatttacgttacgtacggttaccttccccgtcgggtaggtccccgtttaacggaccggtaaacggggtaacctaaaggggtaacgtaaaacctaacggaaaacgtacgttaagggtacggcttccggaacctacccggtttacttacgttacg

SEQ ID NO: 358079 - DNA, 633 bp, Homo sapiens
  misc_feature: GZ8MTXP01C0FTH.52.82.H05.1.454.CMB.2.raw
  modified_base (326)..(326): a, c, t, g, unknown or other
  misc_feature (326)..(326): n is a, c, g, or t
tcagcgcagtacgacacgaccggtgctcgatttagtcgagctctctcgcgggcacgaccggtgctcgatttagtgtgagtagtttgggtttggggtgggtccaggaggcagaactctgggtgtctcaccatggcctggatccctctacttctccccctcctcactctctgcacaggctctggggcctcctattaactgacacagccaccctcggtgtcagtgtcctcaggacagacggccaggatcacctgctctggagatgcactgccaaagcaatatggttaatggtaccagcagaggccaggccagcccctatgtgatataanaagacatcgagagcctcgaggaactcccgtgagcgtattctcgtcggtcctccctcctacgaacgggaaccaaacgtacgtacgtacgttacgtactactactacgacggtagggtacggtaccgggggacggaacggaacgggaacgggacgggtacgtacgtaacgttaacgttaacgttacgtaccgtaaactaaccgtaaaccgaaacgaaacgtaacggttaacggttacggttaacgtttaacgttcgttacgtaacgtacggttaacgggtacgggacgggaaccgtaacgaacgtaacg

SEQ ID NO: 358080 - DNA, 632 bp, Homo sapiens
  misc_feature: GZ8MTXP01DV1U3.52.82.H05.1.454.CMB.2.raw
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtacaaaccgtttatgtctttaattggtaccagcagaagccaggccaggcccctgtgtggtgatatataaggacactgagaggcccctgagggactccctgagcgattctcctggctcccacctcgaaacgggacaacgtagtctacgttacgacccatcagtggacgtccgaaggcaaggaaggacgagggctggaacctaccactagtacaaacgtacaaacagaacagcctaaggttggtttaccttaattcgttccgtttacgctaaacgttcggggaaaccctaaacgggttcccgtaaaccccggttccgttaacgggttacccgaaccgaacccccgtaaaacgggaaccccctaaaacccccggacccttaccggtaaccccgttaaccgtttcccccg

SEQ ID NO: 358081 - DNA, 583 bp, Homo sapiens
  misc_feature: GZ8MTXP01EAR9M.52.82.H05.1.454.CMB.2.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (265)..(265): a, c, t, g, unknown or other
  misc_feature (265)..(265): n is a, c, g, or t
  modified_base (308)..(308): a, c, t, g, unknown or other
  misc_feature (308)..(308): n is a, c, g, or t
  modified_base (331)..(331): a, c, t, g, unknown or other
  misc_feature (331)..(331): n is a, c, g, or t
  modified_base (396)..(396): a, c, t, g, unknown or other
  misc_feature (396)..(396): n is a, c, g, or t
  modified_base (453)..(453): a, c, t, g, unknown or other
  misc_feature (453)..(453): n is a, c, g, or t
tcagcgcagtacgacacgaccggtgctcgatttagtcgagctctctcgcgggggtgggtccaggaggcagaactctgggtgtctcaccatggcctggatccctctacttctcccctcctcactctctgcacaggctctgaggcctcctatgagctgacacagcccaccctcggtgtcagttcgtcccccaggacanacggccaggatccacctgctctgganatattctgtacaaaccgttntgtcttattggaccagcagaaanccaggccacggccctgtgttggtgatatagtaaggacacgtgngacggccctgagggacttcccgngagcgtattctccgtcggctacccgacctcgaaacgggacaacttagtcacgttcgcaaacgttnacgtggaggtccaggcgacagggaccgtaggactcgagtaccaacagttcgaaactnaaccaggacaagtcgacttagggtcgttttaactggtccttacgtcggaaacctaggggttccaaacggtttcgaccgtacccttaggttccgagccccaccggaacacccccacttgtccgaacgtccc

SEQ ID NO: 358082 - DNA, 490 bp, Homo sapiens
  misc_feature: GZ8MTXP01B0IHJ.52.82.H05.1.454.CMB.2.raw
  modified_base (483)..(490): a, c, t, g, unknown or other
  misc_feature (483)..(490): n is a, c, g, or t
tcagcgcagtacgacacgaccggtgctcgatttagtcgagctctctcgcgggcacgaccggtgctcgatttagatcgtctgtgttgggtttgggtccggcagcccccgggaagggcctggagtggattggagatatctactacagcgggggcaccagctacagtccctccctcaagagtcgagttggcatatcaatagacacgtccaagaatcagttctccctgaagctgaaatctatcattgtgcggacacggccgtctattattgtgcgagacatggcagcccatatagtcgctggttcgacccctgggggccccggaatccccggtcaccgtctccccagcttccacaggccccccatcggtctccccctgccgccctgctccaggacgccacctcgtcgggggcacgagcggccctgggctcgcctggtcaaggactacttcctatacgggatcgctgagcggctggcaaggcgcatgnnnnnnnn

SEQ ID NO: 358083 - DNA, 516 bp, Homo sapiens
  misc_feature: GZ8MTXP01D9HIV.52.82.H05.1.454.CMB.2.raw
  modified_base (212)..(212): a, c, t, g, unknown or other
  misc_feature (212)..(212): n is a, c, g, or t
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctggtntcagtcgtccccaggacagacggccaggatcacctgctctggagatatctgtacaaaccgttatgctttatggtaccagcagaagccaggccacggcccctgtgttggtgatatagtaaggcactgagagccctagagggctccctagngcgtattcnctgcctccactcgagggaccactagtctacgttgaccatcgagtggacgtccgaggcaaggaggcgaggcgttacgactacccgatgtacaaatcaaacagacagacagttgttactaatgtcttcgcaacgtcgggaactaacgg

SEQ ID NO: 358084 - DNA, 527 bp, Homo sapiens
  misc_feature: GZ8MTXP01DMXQO.52.82.H05.1.454.CMB.2.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
  modified_base (356)..(356): a, c, t, g, unknown or other
  misc_feature (356)..(356): n is a, c, g, or t
  modified_base (508)..(508): a, c, t, g, unknown or other
  misc_feature (508)..(508): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgganatattctgtcaaaccgttntgcttattggtaccagcagaagcaggccaggccctgtgttgtgatatataaggacactgagaggccctgagggactcccgtagacgcgtattctcctggctaccgacctcgaaagggacncgtacgtcacgttcgaccatcagtgagtccaggcaggaggacgagctagacacatgtacaatcaaacagacagcagtgttctatgtcttcgacaacgtcggaactacggcgtaccgtcttacggttcaccgaaccgaacggccccaaacccncgttacgtccaacttcccg

SEQ ID NO: 358085 - DNA, 524 bp, Homo sapiens
  misc_feature: GZ8MTXP01BBEUL.52.82.H05.1.454.CMB.2.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (517)..(517): a, c, t, g, unknown or other
  misc_feature (517)..(517): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatattctgtcaaaccgttntgcttatggtaccagcagaagccaggccaggcccctgtgttggtgatatataaggacactgagaggccctcagggatccctgagcgattctcctggctcccacctcaacgggacaactagtcacgttgacccatcagtggacgtccaggcagaggacgaggctgactacactgtacaagtcaaacagacagccagttggttcttatgtacttcgcaaacgtcggaccaagggttccaaccgtcttaggttccagcccaacggcccaacccacttcgtccncgttccg

SEQ ID NO: 358086 - DNA, 553 bp, Homo sapiens
  misc_feature: GZ8MTXP01D6MJ3.52.82.H05.1.454.CMB.2.raw
  modified_base (218)..(218): a, c, t, g, unknown or other
  misc_feature (218)..(218): n is a, c, g, or t
  modified_base (534)..(534): a, c, t, g, unknown or other
  misc_feature (534)..(534): n is a, c, g, or t
tcagcgcagtacgacacgaccggtgctcgatttagtcgagctctctcgcgggggtgggtccaggaggcagaactctgggtgtctcaccatggcctggatccctctacttctcccctcctcactctctgcacaggctctgaggcctcctatgagctgacacagccaccctcggtgtcagtcgtcccccaggacagacggccaggatcactgctctgganattattctgtacaaaccgtttatgctttaattggtaccagcagaagccaggccacggcccctgtgttggtgatatataaggacactgagaggcccctgagggatccctgagcgattctccgtggctcccgaccctcgaaacgggacaacgtacgtctacgttcgaccatcgagtggagtaccgaggcgaggaggacggaggctagactaccatgtacaatacaacagacagcagtgttacttatgttcttcgcaaacgtcgggaacctaagggttccaaccgtccttacggttcacgcccaacggcccaaaccccncttcgtccaacgggttccc

SEQ ID NO: 358087 - DNA, 632 bp, Homo sapiens
  misc_feature: GZ8MTXP01AK8D0.52.82.H05.1.454.CMB.2.raw
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
tcagcgcagtacgacacgaccggtgctcgatttagtcgagctctctcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatattctgtcaaaaccgtttntgtcttagttggtaccagacgaagaacgccgacggccgacggccccgtggtggttggtagtattaataagtaaacggactacgtaggacggacggtccccgtacgagggtacctcccgtagacgacgtactttcgtcccgtcggtcctacccgtacccgtcgaaacgggtacctaacgttacgtaccgtacgttcgacctagtacgaggtcggacgtaccgaggacgaaggagggacggaggcgtacgacctaccacgtacgtacaacgtacaaacgacgacagcgtaggttgtttacttatcgttacttcgactaacggtcggaaccgacggttccgtaccgtcgttacggttcgacgaacccgaacgccccaaccctcgttcgtccgcctcg

SEQ ID NO: 358088 - DNA, 539 bp, Homo sapiens
  misc_feature: GZ8MTXP01BP6W9.52.82.H05.1.454.CMB.2.raw
  modified_base (217)..(217): a, c, t, g, unknown or other
  misc_feature (217)..(217): n is a, c, g, or t
  modified_base (284)..(284): a, c, t, g, unknown or other
  misc_feature (284)..(284): n is a, c, g, or t
  modified_base (360)..(360): a, c, t, g, unknown or other
  misc_feature (360)..(360): n is a, c, g, or t
  modified_base (525)..(525): a, c, t, g, unknown or other
  misc_feature (525)..(525): n is a, c, g, or t
  modified_base (534)..(534): a, c, t, g, unknown or other
  misc_feature (534)..(534): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgganatattctgtctaaaaccgttatgctttattggtaccagcagaagccaggccaggcccctgtgttggngatatataaggacactgagacggcccctcgagggactcccgtgagcgattctcctcggctccacctcaaagggacncgtagtccacgttcgaaccatcgaaggtcggagtccgaaggcaaggagggaacggaggactcgaacctaccatgtacaagtacaaacagacagacagttgttctatgtcttcgacaagtcggacgaacgttcgaccgtcttaggttcacgcccacgcccaacccncttcgtccnctccg

SEQ ID NO: 358089 - DNA, 699 bp, Homo sapiens
  misc_feature: GZ8MTXP01BNWLJ.52.82.H05.1.454.CMB.2.raw
  modified_base (241)..(241): a, c, t, g, unknown or other
  misc_feature (241)..(241): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctggtgtcagtcgtccccaggacaggacggccaggatcacctgctctggatatattctgtactaaaccgtttntgtacttagttacgtacagacaagaacgcgacggaccgaccggtcccgtggttggttaggtagtaattaagtaaagtaaacggactacgtaggaacggacggtcccgtacggacgggtactccgtagacgtacgtacttccgtccgtcggtcctacccgaccgtacgaacggactaacgtacgtacgtacgtacgaacctagtacgtagtacgacgtacggaggacgaaggacgggacggacgtacgtacgaacctaaccgtacgtacgtaacaaacgtaacgaaacgaacgaacgacgtacgttaggtttacgtttacgttagttccgttaccgtacgtaacgtaaccggtaccggttaaccgtaacggttacccgtaaccgttaccgttacggttacccaaccggtaacccaacccgaacccctaacccgtaccgttcctaacccgttccgttccg

SEQ ID NO: 358090 - DNA, 541 bp, Homo sapiens
  misc_feature: GZ8MTXP01ATBND.52.82.H05.1.454.CMB.2.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (431)..(431): a, c, t, g, unknown or other
  misc_feature (431)..(431): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatattctgtcaaaccgttntgcttatggtaccagcagagccaggccaggcccctgtgttggtgatatataaggacactgagacggccctgagggactccctgagcgattctctggctcccacctcgaagggacaacgtagtcacgttgacccatcgagtggagtccgaggcaggaggacgaggctgacctacatgtacaatcaacagacagcngtggttaccttatcgtcttcgctaacgtcgggaccaaaggttccgaccgtccgttaggttccacggaaccccaaggccccaaaccccgtcttcgtaaccaaccgttcccg

SEQ ID NO: 358091 - DNA, 482 bp, Homo sapiens
  misc_feature: GZ8MTXP01EOFI3.52.82.H05.1.454.CMB.2.raw
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
  modified_base (343)..(343): a, c, t, g, unknown or other
  misc_feature (343)..(343): n is a, c, g, or t
  modified_base (426)..(426): a, c, t, g, unknown or other
  misc_feature (426)..(426): n is a, c, g, or t
  modified_base (436)..(436): a, c, t, g, unknown or other
  misc_feature (436)..(436): n is a, c, g, or t
  modified_base (461)..(461): a, c, t, g, unknown or other
  misc_feature (461)..(461): n is a, c, g, or t
  modified_base (477)..(477): a, c, t, g, unknown or other
  misc_feature (477)..(477): n is a, c, g, or t
  modified_base (480)..(480): a, c, t, g, unknown or other
  misc_feature (480)..(480): n is a, c, g, or t
tcagcgcagtacgacacgaccggtgctcgatttagtcgagctctctcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatattctgtcaaaccgttatgcttattggtaccngcagaagcagcaggccctgtgtgngatatataaggcactgagaggccctgagggatcccgtgagcgattctcctggctccacctcaagggacnctagtcacgttgaccatcagtggagtccaggcagaggacgaggctgactacactgtacatacaacagacagtcagtggtcttntagtcttcgnaactcggacaggttcacgtcagttngccagccctacacttntcntc

SEQ ID NO: 358092 - DNA, 635 bp, Homo sapiens
  misc_feature: GZ8MTXP01ADS8J.52.82.H05.1.454.CMB.2.raw
  modified_base (279)..(279): a, c, t, g, unknown or other
  misc_feature (279)..(279): n is a, c, g, or t
  modified_base (326)..(326): a, c, t, g, unknown or other
  misc_feature (326)..(326): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttcctccccctcctcactctctgcacaggctctgaggcctcctatgagctgacacacgccaccctggtgtcagtcgtccccaggacagacggccaggatcacctgctctggagatatctagtactaaaccgttntgtcttattcggtaccagcagagccagccacggcccctgtgttggtnataagtataaggacacgtgaacgtcgccctagacgggtctcccgtagacgcgtacttcgtcgtacggtccctaccctaccgtacgacgggtacctacgttacgtaccgtacgttcgaaccctagttaccgagggttacgggacgggtccgaagggcccgaaagggacgggaacggtagggacctacggaacccgtaacctaacgttcgaacctaaataccgaaaccgagaacccgacggacgttacgggtttggttaccttaagtcgttccgttacggaccgttaacgttcgggggaacctaaccgggg

SEQ ID NO: 358093 - DNA, 611 bp, Homo sapiens
  misc_feature: GZ8MTXP01BS3LF.52.82.H05.1.454.CMB.2.raw
  modified_base (212)..(212): a, c, t, g, unknown or other
  misc_feature (212)..(212): n is a, c, g, or t
  modified_base (322)..(322): a, c, t, g, unknown or other
  misc_feature (322)..(322): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctggtntcagtcgtccccaggacagacggccaggatcacctgctctggagatatctgtctaaaccgttatgcttattggtacagcagaagccaggccaggcccctgtcggttggtnatatataagaccactgagacggccctaacgagggtaactcccgtgagcgtattctcgtcggcctccgacccttcgacgggaaccacgttacgtacgtacgttcgaaccctataccgaggttcggacggttcgaacgggcgaacgggacggacggaggctacggacctaaccctatacgtacaaactaccaaacgtaacgaccgaagtccgttaagggtttcggtttaccctttaagttcggttccttaccggtaccttaccgggttaacgggaacccgttaaaccgggg

SEQ ID NO: 358094 - DNA, 511 bp, Homo sapiens
  misc_feature: GZ8MTXP01DQLO4.52.82.H05.1.454.CMB.2.raw
  modified_base (321)..(321): a, c, t, g, unknown or other
  misc_feature (321)..(321): n is a, c, g, or t
  modified_base (435)..(435): a, c, t, g, unknown or other
  misc_feature (435)..(435): n is a, c, g, or t
  modified_base (481)..(481): a, c, t, g, unknown or other
  misc_feature (481)..(481): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccacctcggtgtcagtcgtccccaggacagacggccaggatcacctgctctggagatatctgtacaaaccgttatgcttattggtaccagcagaagccaggccaggcccctgtcgttggngatatataaggaccactgagaggccctagagggctcccgtgacgcgtattctctcggcctccacctcgagggacactagtctacgttgacatcagtgaggtcaggcagagacgnggctagactaccgactgtcaatcaaacagaccgagcagttcggttnttaatgtcttcgcacgtgggaacctaacgg

SEQ ID NO: 358095 - DNA, 610 bp, Homo sapiens
  misc_feature: GZ8MTXP01CU827.52.82.H05.1.454.CMB.2.raw
  modified_base (215)..(215): a, c, t, g, unknown or other
  misc_feature (215)..(215): n is a, c, g, or t
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
  modified_base (272)..(272): a, c, t, g, unknown or other
  misc_feature (272)..(272): n is a, c, g, or t
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
tcagcgcagtacgacacgaccggtgctcgatttagtcgagctctctcgcggggtgggtccaggaggcagaactctgggtgtctcaccatggcctggatccctctacttctcccctcctcactctctgcacaggctctgaggcctcctatgagctgacacagccaccctggtgtcagtgtccccaggacagacggccaggatcacctgctctgganatattcngtcaaaccgtttngtacttagtgacagacagagcgagcacgcctgtgtgnatatagagcangagacgccngaggactccgtgagcgtattctccgtcggtcctaccaccgtcgaacgggactaacgtacgtcgtacgttcgacctagtcgtaggtcggacggtccgggacgagggacggacggaggtactacgaacctaccgtacgtacgtactaactacgaacgagacagtcgtaggttcgtttacttagttcgttccgttacgacgtaacggtaacgggaacccgttaacgggtacccgacccgttacggtacggttaccgaccgacccgtaaaccggaccccctaaccccgtacgtccgttaccctaaccgttcccgttaacccg

SEQ ID NO: 358096 - DNA, 607 bp, Homo sapiens
  misc_feature: GZ8MTXP01DQ6VV.52.82.H05.1.454.CMB.2.raw
  modified_base (216)..(216): a, c, t, g, unknown or other
  misc_feature (216)..(216): n is a, c, g, or t
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttcctccccctcctcactctctgcacaggctctgaggcctcctatgagctgacacacgcccaccctcggtntcagtcgtccccaggacagacggccaggactcacctgctctgganatatctgtactaaacgttntgtcttagtgacagcagacgccgaggccgacggtccccttggttggttaggtagtaattaataagtaaggaccacgtaggacgtacggccctaacgaagggtctcccgtgacgtcgtattctcgtcgcctccgactcgaggactacgtagtctacgtcgactatcgaaggtcggaacggtccgaagggacagggaacggacgagacgtacgtacctaaccgtatacgtaacaaataccaaacgacggaacaggtcgttaaggttcggtttaaccttaagttcgttcgttaccggacgttaaccgggtcgggttaaccgtaacccggg

SEQ ID NO: 358097 - DNA, 555 bp, Homo sapiens
  misc_feature: GZ8MTXP01A47XN.52.82.H05.1.454.CMB.2.raw
  modified_base (217)..(217): a, c, t, g, unknown or other
  misc_feature (217)..(217): n is a, c, g, or t
  modified_base (255)..(255): a, c, t, g, unknown or other
  misc_feature (255)..(255): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
  modified_base (341)..(341): a, c, t, g, unknown or other
  misc_feature (341)..(341): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (382)..(382): a, c, t, g, unknown or other
  misc_feature (382)..(382): n is a, c, g, or t
tcagcgcagtacgacacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagagagagtgtgttgggtttggggagcttggtccagcctggtgttccctgagactctcctgtgcagcctntggattctccgtcagtagcaactcatgagctgggtccncaggctccgagggagggctggagtggtctcaagttctttagcgtcggtgtaccatatattangctgactcgngaggccattccacntcncaagacncgatccagacngcctgttactacaatggacngtctgacgacctgaccgacacggtctgtactagttacgtggtcgacgaagaccgacccggagggggcggactcgacggtccccgtaagtcggcgggggacccacggggacccggtcaccggttccttccgcgaacgccctccgaccgacggggcccctaagttcccggtcccc

SEQ ID NO: 358098 - DNA, 574 bp, Homo sapiens
  misc_feature: GZ8MTXP01BAPKG.52.82.H05.1.454.CMB.2.raw
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatatctgtacaaaccgttatgcttattggtaccagcagaagccaggccacggcccctgtcgttggtgatatataaggaccacgtagagacggccctacgagggtaactcccgtgacgcgtattctcgtcggccttccaccgtcgacgggaccacgtacgtctacgttacgaccatccgaggtggacgggtcccgaagggccagggaggacgaggctaggacctaccgactgtacaaagtcaaacacgacgacgacttaggttcggttacttaacgtcgttccttcggaccgttaacggtccgggaaccgtaaaccggg

SEQ ID NO: 358099 - DNA, 548 bp, Homo sapiens
  misc_feature: GZ8MTXP01CKLZF.52.82.H05.1.454.CMB.2.raw
  modified_base (237)..(237): a, c, t, g, unknown or other
  misc_feature (237)..(237): n is a, c, g, or t
  modified_base (351)..(351): a, c, t, g, unknown or other
  misc_feature (351)..(351): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttntgcttatgtaccagcagagcaggccaggccctgtgtggtgatatataaggacactgagacggccctcgagggactcccgtgagcgattctcctggctccacctcgaacgggacncgtagtcacgttcgaccatcagtggacgtaccgaggcgaaggaggacggaggctacgactaccactgtacaaagtcaaacgagaccagcagttggttcttatgtcttcgcaacgtcgggaacctaaggttccgaaccgttccgttacggttcacggaaccccgaaaggccccaaccccacttcgtccaactttcccg

SEQ ID NO: 358100 - DNA, 568 bp, Homo sapiens
  misc_feature: GZ8MTXP01A2MAJ.52.82.H05.1.454.CMB.2.raw
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctggagatattctgtacaaaccgttatgctttattggtaccagcagaagccaggccaggcccctgtgttggtgatatataaggacactgagaggccctcgagggactccctgagcgattccgtcctggctcccgacctcgaagggaccaactagtcgtacgttcgaccatcagtggagtccgaggcaaggaggacgaggtctagactaccactgtacaagtcaaacagaaccagtccaggttggttaccttagtcgttcgttacgctaaacgtcggggacctaaagggttcctaccgtccgttaggttccacggaaccccaagggccccaaccccgattcgtccttaaccgttcccg

SEQ ID NO: 358101 - DNA, 561 bp, Homo sapiens
  misc_feature: GZ8MTXP01B2NK8.52.82.H05.1.454.CMB.2.raw
  modified_base (210)..(210): a, c, t, g, unknown or other
  misc_feature (210)..(210): n is a, c, g, or t
  modified_base (323)..(323): a, c, t, g, unknown or other
  misc_feature (323)..(323): n is a, c, g, or t
  modified_base (488)..(488): a, c, t, g, unknown or other
  misc_feature (488)..(488): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctcccctctcactctctgcacaggctctgaggcctcctatgagctgacacagccaccctggtntcagtgtccccaggacagacgccaggatcacctgctctggagatatctgtctaaacgttatcgtcttattggtaccagcaagaacgcaggccaggcccctgtgttggtgatanataaggacactgagacgccctaacgagggaactcccgtgacgtcgatttccgtcgtcggccttccacccgtcgacggggaactaccgtaaggtctacgttacgaccagtccagttcggagtccgaaggggcaaggaggacgacggctacggacctaccacgttanaacaatacaagacgacgagtcgttagttcgttacttaagtcgttcgtcgacgttacggtaacggaacgtaacg

SEQ ID NO: 358102 - DNA, 574 bp, Homo sapiens
  misc_feature: GZ8MTXP01D1AD5.52.82.H05.1.454.CMB.2.raw
  modified_base (219)..(219): a, c, t, g, unknown or other
  misc_feature (219)..(219): n is a, c, g, or t
  modified_base (239)..(239): a, c, t, g, unknown or other
  misc_feature (239)..(239): n is a, c, g, or t
  modified_base (363)..(363): a, c, t, g, unknown or other
  misc_feature (363)..(363): n is a, c, g, or t
  modified_base (406)..(406): a, c, t, g, unknown or other
  misc_feature (406)..(406): n is a, c, g, or t
  modified_base (437)..(437): a, c, t, g, unknown or other
  misc_feature (437)..(437): n is a, c, g, or t
  modified_base (549)..(549): a, c, t, g, unknown or other
  misc_feature (549)..(549): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatattctgtacaaaccgttntgctttattggtacagcagaagccaggccaggcccctgtgttggtgatatataaggacactgagacggccctcgagggactccctggacgcgattctctcggtctacccacctcgaacgggacncgtagtcctacgttgaccatcagtgagtccaggcaggagacgngctgactacactagtacaacgtcaacgaganacgcgtagttcggttacttagttcgttccttacgctaaacgttcgggaaccaaacgggttccaaccggttccgttagggttcccaacggccccgaaacggcccaaaaccccncgttcgtaaccttaaccgtttcccg

SEQ ID NO: 358103 - DNA, 612 bp, Homo sapiens
  misc_feature: GZ8MTXP01BA3EE.52.82.H05.1.454.CMB.2.raw
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (361)..(361): a, c, t, g, unknown or other
  misc_feature (361)..(361): n is a, c, g, or t
  modified_base (379)..(379): a, c, t, g, unknown or other
  misc_feature (379)..(379): n is a, c, g, or t
tcagcgcagtacgacacgaccggtgctcgatttagtcgagctctctcgcgggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcacctgctctgganattattctgtactaaaaccgttntgtactttattcggtaccagtcaagaacgccgaggccacggcccctggtcggttggtgtatatagtaaaggacacgtgagacggccctcgagggactccgtgagcgattctcctggtcncctacctcgaacgggacncgtagtcctacgttcgacctatcgagtggacgtccgaggcaaggacgggtaacggaggtctacggacctaccactagtaccaaaggtacaaacgaaggaacagccgaggttggttacttagtcgtcttcgactaacggttacggaccgtaaacgttccgaacccgttcgaacgggttcaaccggaacccaacggccccaaacccgtacttccggtaaccgttaacccttcccg

SEQ ID NO: 358104 - DNA, 724 bp, Homo sapiens
  misc_feature: GZ8MTXP01CABFY.52.82.H05.1.454.CMB.2.raw
tcagcgcagtacgacacgaccggtgctcgatttagtcgagctctctcgcgggggtgggtccaggaggcagaactctgggtgtctcaccatggcctggatccctctacttctccccctctcactctctgcacaggctctgaggcctcctatgagctgacacagccaccctcggtgtcagtgtccccaggacagacggccaggatcactgctctggagatattctgtacaaaccgttatgctttattggtaccagcagaagccaggccacggccctgtgttggtgatatataaggacactgagacggcccctgagggactcccgtagacgcgtatttccgtccgtggcctcccaaccctcggaaaacggggtacctaacgttagttcccgtaacggtttcgaacccctagttaccgaagggttacgggtaacggtacccgaacggggacgaacggggaaacggggaaccgggacgggtaccgtacggaaacccgttaaccctaacgttacgttaaccgaaacgttaaccgaaaacgaacgaaccgaacggtcccgtaaaggtttcgggttttacctttaaggttccggtttaccgtttaccggaccgtaaacggttacggggaaacccgtaaacggttcccgtaaacccggttccgttaacgggttccaacggaaccccgaacggaaccccaaccccgtagttccgtaacccttaaccgtttcccg

SEQ ID NO: 358105 - DNA, 633 bp, Homo sapiens
  misc_feature: GZ8MTXP01CJ8OO.52.82.H05.1.454.CMB.2.raw
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcacctgctcgtggagatatctgtactaaaccgttatgtactttagttcgtaaccagacaagaacgcccgaacggcccgacgggtcccccttggttggtttggtagtattaaatagtaaacgggaccctacgtaggacggaccggtcccctaacggaacggggtcctcccgtaggacggtcgtactttccgtctcgggtcctacccgtacctacgacgggacacgttacgtaccgtacgtcgaacctatacgagttacggacggtacgaggaccgaggacggacgagtacgtacgacctaccgacgtgtacaacgtacaaacgagaccgaggcgttagttcggttactttaagtcgtttccgtcgacgttacgtcgggaaccgttaaccgg

SEQ ID NO: 358106 - DNA, 546 bp, Homo sapiens
  misc_feature: GZ8MTXP01DQGRB.52.82.H05.1.454.CMB.2.raw
  modified_base (222)..(222): a, c, t, g, unknown or other
  misc_feature (222)..(222): n is a, c, g, or t
  modified_base (243)..(243): a, c, t, g, unknown or other
  misc_feature (243)..(243): n is a, c, g, or t
  modified_base (360)..(360): a, c, t, g, unknown or other
  misc_feature (360)..(360): n is a, c, g, or t
  modified_base (429)..(429): a, c, t, g, unknown or other
  misc_feature (429)..(429): n is a, c, g, or t
  modified_base (453)..(453): a, c, t, g, unknown or other
  misc_feature (453)..(453): n is a, c, g, or t
  modified_base (529)..(529): a, c, t, g, unknown or other
  misc_feature (529)..(529): n is a, c, g, or t
tcagcgcagtacgacacgaccggtgctcgatttagtcgagctctctcgcgggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacaggacggccaggatcacctgctctgganatattctgtacaaaccgtttntgtcttattcggtaccagcagaagccgaggccaggcccctgtgttggtgatatataaggacactgagaggccctgagggactcctgagcgattctcctggctccactcgaagggacncgtagtcacgttcgaccatcagtgagtccgaggcaggaggacgaggctgacaccatgtacaagtcaaanagaaccgagcgagttggttacttntcgtcgttcgctaacgtcgggaactaacggttccgaaccggtcttacggttcacgccccgaaaggcccaaccccgnttcgtcaacgttccccg

SEQ ID NO: 358107 - DNA, 617 bp, Homo sapiens
  misc_feature: GZ8MTXP01EL5AI.52.82.H05.1.454.CMB.2.raw
  modified_base (210)..(210): a, c, t, g, unknown or other
  misc_feature (210)..(210): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctccccctctcactctctgcacaggctctgaggcctcctatgagctgacacagccacctggtntcagtcgtccccaggacagacggccaggatcacctgctctggagatatctgtacaaaccgttatgtcttattgtaccagcagaagcaggccaggcccctgtgtggtgatatataagacactgagacgccctacgaggctccctgacgcgtattctcgtcggtccttaccacctcgaacgggacctaacgtacggtactacgttcgaacccattcgaaggttcggacggtccgaagggccgaagggacgggaacggacggtaccgtaggtaaccctaccgtaactttcggtaacaaacgttaccaaacgtaacgaaccgtaaggaccgttagggtttcgggtttacctttaagttcgttaaccgtttcggaaccttaaccgggttaacgggaacccgttaaacccggg

SEQ ID NO: 358108 - DNA, 503 bp, Homo sapiens
  misc_feature: GZ8MTXP01AYCC5.52.82.H05.1.454.CMB.2.raw
  modified_base (210)..(210): a, c, t, g, unknown or other
  misc_feature (210)..(210): n is a, c, g, or t
  modified_base (371)..(371): a, c, t, g, unknown or other
  misc_feature (371)..(371): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctcccctcctcactctctgcacaggctctgaggcctcctatgagctgacacagccacctggtntcagtgtccccaggacagacggccaggatcacctgctctggagatatctgtcaaaccgttatgtcttattgtaccagtcagaagccgaggccaggcccctgtcgttggtgatatagtaaggaccactgagacgccctaagagggctccctgagcgtattcnctcgctccacctcgagggacagtacgtcacgttcgaccatcagtcgagtccgagcagagcgagctagactacactgtacaatcaacagacagcagttgttactaatgtcttcggcaacgtcggaactaacgg

SEQ ID NO: 358109 - DNA, 703 bp, Homo sapiens
  misc_feature: GZ8MTXP01EJ550.52.82.H05.1.454.CMB.2.raw
  modified_base (260)..(260): a, c, t, g, unknown or other
  misc_feature (260)..(260): n is a, c, g, or t
tcagcgcagtacgacacgaccggtgctcgatttagtcgagctctctcgcgggcacgaccggtgctcgatttagtcgagctctctcgcgggcacgaccggtgctcgattttagtcgagctctctcgcgggcacgaccggtgctcgatttagagagagtgtgttgggtttggggagcttggtccagcctggtggttccctgagactctcctgtgcagcctctggattctccgtcaagtagcaactacatgagctgggtcccncaggctccgagggagggctggagtgggtctcaaggttctttagcggtcggtgtacccatattattatcgcttcgacttccggtagaacgggtcctattccacctatcctaccgaaagacgaacgacgtcccgaaagggaacctacggtccttgtttttacctacaaagtcgggaactaggttctaggaacgtaccgtaggaccgacaccgggtcttagttaccttaacgttacgtgttaccgggaccgaaggaccggaaaccccggaggggggaccggtacgaccgtaccggtaacccccggttaagttcccgggtaacgggggccctaaacccgggggttaccccggtacgtaaccccggttccttcccgttaccgaaccggtccccctaaccccgaacccggtaacgggggccccccttaaggttccccggggtttccccc

SEQ ID NO: 358110 - DNA, 547 bp, Homo sapiens
  misc_feature: GZ8MTXP01ADDML.52.82.H05.1.454.CMB.2.raw
  modified_base (159)..(159): a, c, t, g, unknown or other
  misc_feature (159)..(159): n is a, c, g, or t
  modified_base (304)..(304): a, c, t, g, unknown or other
  misc_feature (304)..(304): n is a, c, g, or t
  modified_base (504)..(504): a, c, t, g, unknown or other
  misc_feature (504)..(504): n is a, c, g, or t
  modified_base (522)..(522): a, c, t, g, unknown or other
  misc_feature (522)..(522): n is a, c, g, or t
  modified_base (527)..(527): a, c, t, g, unknown or other
  misc_feature (527)..(527): n is a, c, g, or t
  modified_base (530)..(530): a, c, t, g, unknown or other
  misc_feature (530)..(530): n is a, c, g, or t
  modified_base (539)..(539): a, c, t, g, unknown or other
  misc_feature (539)..(539): n is a, c, g, or t
  modified_base (542)..(542): a, c, t, g, unknown or other
  misc_feature (542)..(542): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagcgtgggttttccncgttgcttcttttaagaggtgtccagtgtcaggtacaactggtggagtcgtgggggagcgtggtccagccgtgggagtccctgagactctcctgtgcagccctgtggattcaccttcagtacctatagtatacacgtgggtcccncaggctccgtggacaagggactgggagtgggtgctagtctatatacaaatgataggaaacaataaacccattcacagaaccgtacggtaaagggctacttaccaccatccacagacacaacttaccaagaactcggtctactacgtaacaaagtgaaacgtgttacgagtacttggaacggtacaggtctagtatagtcngttgcgagtaggtattgnttagngcncgtcacganccntaacc

SEQ ID NO: 358111 - DNA, 609 bp, Homo sapiens
  misc_feature: GZ8MTXP01BP4G1.52.82.H05.1.454.CMB.2.raw
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
  modified_base (565)..(565): a, c, t, g, unknown or other
  misc_feature (565)..(565): n is a, c, g, or t
  modified_base (580)..(580): a, c, t, g, unknown or other
  misc_feature (580)..(580): n is a, c, g, or t
  modified_base (584)..(584): a, c, t, g, unknown or other
  misc_feature (584)..(584): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtacaacgtggtggagtcgtgggggagcgtggtccaggccgtgggacggtccctgagtactctcctgtgcagcctntgattcaccttnagtactatagtatacacgtgggccncaggctccgnggacaagggctgggagtggggtgctatctaatatacaaagtgaataggaaaacaactaaaacccatttccaacacggtaaccttacccgggtaaaggggtcccctaatttacccaacctaatcctaccgagtaacgaactaaacttaccgaaagaaccgtacggtactactaactaaacaaagtacgaaacttagtttagagtaccgttaggacggtaccgaacggtcttagtattataactggttgccgngtaagggtaattcgnttangcaacgcctaggaactaaccttgtc

SEQ ID NO: 358112 - DNA, 648 bp, Homo sapiens
  misc_feature: GZ8MTXP01AN0OK.52.82.H05.1.454.CMB.2.raw
  modified_base (218)..(218): a, c, t, g, unknown or other
  misc_feature (218)..(218): n is a, c, g, or t
  modified_base (239)..(239): a, c, t, g, unknown or other
  misc_feature (239)..(239): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctgganattattctgtacaaaccgttntgtcttattcggtaccagcagaacgccgaggccacggcccctgtgttggtgatatagtaaggacagtgagaggccctgagggctcccgtgacgcgtattctccgtcggctcccgaccgtcgaacgggacctaacgttacgtaccgtaacgttcgaaccctagttacgagggttacgggacgttacccggaaggggaccgaagggaacgggaaccggacgggtccgtacggaaccttaccgacgtacgtacctaaactacgaaacgacgaacgagtccgtaggttacggttacttaagtcgttcgttcgacgtaacggtcgggaacctacgggttccgtaaccggtcgttacggttccaccggaacccgaaccggccccaacccgtcgttacgtaaccttaacgttcccg

SEQ ID NO: 358113 - DNA, 511 bp, Homo sapiens
  misc_feature: GZ8MTXP01DKODN.52.82.H05.1.454.CMB.2.raw
  modified_base (464)..(464): a, c, t, g, unknown or other
  misc_feature (464)..(464): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccacctcggtgtcagtcgtccccaggacagacggccaggatcacctgctctggagatatctgtcaaaccgttatgcttattggtaccagcagaagccaggccaggcccctgtgtggtgatatataaggaccactgagacggccctacgagggaactcccgtgagcgattctcgtcggctccacctcgacgggacactagtcacgttgaccatcagtggagtccgaggcaaggagagaggctagactaccatcgtacaatcaanagacagcagttggttactgtagtcttcgcaacgtgggaacctaacgg

SEQ ID NO: 358114 - DNA, 586 bp, Homo sapiens
  misc_feature: GZ8MTXP01BLT4S.52.82.H05.1.454.CMB.2.raw
  modified_base (256)..(256): a, c, t, g, unknown or other
  misc_feature (256)..(256): n is a, c, g, or t
  modified_base (388)..(388): a, c, t, g, unknown or other
  misc_feature (388)..(388): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctgganatatctgtactaaaccgttatgcttatggtaccagcaagacgccaggccacggcccctgtgttggtgatagtaataaggacctactggaagacggcccctagaacgggtctcccgtaggacgcgtactttcncgtacggtccctccaccgtgacgggacctacgtacgtcgtacgttcgaacctataccgaagttcgggacggtacccgagggaccgaaggacgggacgacgggctacgacctaccacgtacgtcaaactcgaaacagaccgagtcttaggttgtttacttaatgtcgtttcgacgttaacggttcgggaacctaacggg

SEQ ID NO: 358115 - DNA, 564 bp, Homo sapiens
  misc_feature: GZ8MTXP01CMJ17.52.82.H05.1.454.CMB.2.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (280)..(280): a, c, t, g, unknown or other
  misc_feature (280)..(280): n is a, c, g, or t
  modified_base (440)..(440): a, c, t, g, unknown or other
  misc_feature (440)..(440): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatattctgtcaaaccgttntgcttattgtaccagcagagccaggccaggcccctgtgttggngatatataaaggacactgagacggccctcgagggactcccgtgagcgtattctccgtggcctccacctcgaaagggacaactagtctacgttcgaccatcgagtggagtccgaggacaggaggacgaggctacgacctaccactgtaccaagtcaaaganacgagcgtaaggttggtttcttaagttgttcttacgacctaacgtcgggaacctaacggttcctaacccgtcgttacggttcacgaacccgacggaacccaaccctagttctcgaaccttcccg

SEQ ID NO: 358116 - DNA, 638 bp, Homo sapiens
  misc_feature: GZ8MTXP01ER3GH.52.82.H05.1.454.CMB.2.raw
  modified_base (219)..(219): a, c, t, g, unknown or other
  misc_feature (219)..(219): n is a, c, g, or t
  modified_base (240)..(240): a, c, t, g, unknown or other
  misc_feature (240)..(240): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganattattctgtacaaaccgttntgcttattcggtaccagcagaacgccgaggccacggccctgtgtggtgatatataaggacacgtgagacggccctgacgggactcccgtgacgcgtattctcgtcggtcctccaccctacgaaacgggacctaactacgtactacgttcgaactactcaggtacggacgtaccgagggacgaggaacgggtacgacggactcggaacctaaccacgtagtacaaacgtcaaacgagaacacgtcgtaagtttaggtttctttaagtcgtttaccgttcgaccgtaacggtcgggttaaaccggtaacgggttaccgtacccggtaccggttacggttaccgaccggaaccccgaacggaaccccccaacccgtacgttcgtcccttaaccgttccccg

SEQ ID NO: 358117 - DNA, 528 bp, Homo sapiens
  misc_feature: GZ8MTXP01BIEPB.52.82.H05.1.454.CMB.2.raw
  modified_base (281)..(281): a, c, t, g, unknown or other
  misc_feature (281)..(281): n is a, c, g, or t
  modified_base (360)..(360): a, c, t, g, unknown or other
  misc_feature (360)..(360): n is a, c, g, or t
  modified_base (514)..(514): a, c, t, g, unknown or other
  misc_feature (514)..(514): n is a, c, g, or t
  modified_base (521)..(521): a, c, t, g, unknown or other
  misc_feature (521)..(521): n is a, c, g, or t
tcagcgcagtacgacacgaccggtgctcgatttagtcgagctctctcgcgggggtgggtccaggaggcagaactctgggtgtctcaccatggcctggatccctctacttctcccctctcactctctgcacaggctctgaggcctcctatgagctgacacagccaccctcggtgtcagtgtcccccaggacagacggccaggatcacctgctctggagatattctgtcaaaccgttatgcttattggtaccagcagaacgccaggccaggccctgtgttggngatatataaggacacgtgagacggccctcgagggatcccgtgacgcgtattcgtcctcggctccacctcgaagggaccncgtagtcacgttcgacctatcagtgagtccaggcagaggacgaggctagacctacactgtacaatcaaacgagacagcagttggttctagtcgtcttcgctaacgtgggaccaggttccacgtccgaggttcacgcccaacggcccaaaccctnttcgtcncttcccg

SEQ ID NO: 358118 - DNA, 604 bp, Homo sapiens
  misc_feature: GZ8MTXP01ANRZN.52.82.H05.1.454.CMB.2.raw
  modified_base (258)..(258): a, c, t, g, unknown or other
  misc_feature (258)..(258): n is a, c, g, or t
  modified_base (281)..(281): a, c, t, g, unknown or other
  misc_feature (281)..(281): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatattctgtcaaaccgttatgcttattggtaccagcagaanccaggccaggcccctgtgttggngtatatataaggacactgagaggccctgagggactcccgtgagcgattctccgtggctcccacctcgaaacgggaccaacgtagtccacgtttcgaccctatcagttcggagtcccgaggccgaggacggacgacggctcggaactacccattcgtacaaatcaaacgagaacagcagttggtttaccttagtcgttacttccgcgtaaacgttgggaacccgtaaacggttccgacccggttaccgttacgggttccgaccggaacccccgaaacgggaacccccaaaacccccgcgttaccgtccttaacccgtttccccg

SEQ ID NO: 358119 - DNA, 582 bp, Homo sapiens
  misc_feature: GZ8MTXP01ANHAP.52.82.H05.1.454.CMB.2.raw
  modified_base (241)..(241): a, c, t, g, unknown or other
  misc_feature (241)..(241): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcactgctcgtggatattattctgtactaaaccgttntgtcttagttcggtaccagcagaagccaggccaggcccctgtgtggtgatatataaggacagtgagacggccctgagggactccgtgagcgattctcctcggctccgaccctgaaacgggacaactagtcgtacgttcgaacatacgagtggagtccgaggcaggaggacgagggctaggaaccttaccactagtacaaatacaaacgagactacgcgtaggttcggtttactttaagtcgttcttacgctaacggtcggaacgtaagggccctacggtcttacggttcaccggtaacccaacggaacccctaacccgattccgtccgttaaccttccccg

SEQ ID NO: 358120 - DNA, 638 bp, Homo sapiens
  misc_feature: GZ8MTXP01CD3XD.52.82.H05.1.454.CMB.2.raw
  modified_base (176)..(176): a, c, t, g, unknown or other
  misc_feature (176)..(176): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagcccaccctcggtntcagtcgtccccaggacagacggccaggatcacctgctctggagatattctagtactaaaccgttatgtacttagttcgtaccagcaagaagccaggccacggcccctgtgttggtgtaatataagtaaaggacacgtgaaggacggacccctcgaagggtactcccgtagacgcgacttctccgtcggctcccacctcgaaagggacctaacgtacgtcctacggtttcgaacctactcgaacggtgggtacgtacccgagggacgaaggaacgggacggacgggacgttacggaaccttaccacgtgtaaccaaatacgaaacgacgaacgacgtcgtaggttaggttcttagtacgttcgtttcgacgtaacgtcggggacctaacggttcgtaacccgtcgttacggttccacgaacccaacggtccccaaccctacgttcgtccttaaccgttcccg

SEQ ID NO: 358121 - DNA, 670 bp, Homo sapiens
  misc_feature: GZ8MTXP01DGWH8.52.82.H05.1.454.CMB.2.raw
  modified_base (246)..(246): a, c, t, g, unknown or other
  misc_feature (246)..(246): n is a, c, g, or t
tcagcgcagtacgacacgaccggtgctcgatttagtcgagctctctcgcgggggtgggtccaggaggcagaactctgggtgtctcaccatggcctggatccctctacttcctccccctcctcactctctgcacaggctctgaggcctctatgagctgacacagcccacccgtcggtgtcagtcgtccccaaggacagacggccaggatccacctgctcgtggatatattctgtacctaaaccgttntgtactttagttcgtaccagcaagaaagccgaggccgacggtcccctggtggttggtgaatataagaaggacataggagacgccctagagggtactccgtgacgcgtattctccgtcggcctacccacccgtacggaaacgggaacctaacgtagtaccgtaacggtttacgaaccctagtacgtaggtaggtacgttaccggaaggccgaagggaacgggaacggaacgggtccttaggaacccttaaccgacgttacgtaaccgaaattacccgaaaaagacgaacgacgtaccgttaggtttcgtttacgttacgtcgttaccgtacgaacgtaacggtcggaaccgtacggttccgtaccgtacgttacgccgaccgaacccgaaccgcccaaccgtcgttacgtaaccgttccgtcccg

SEQ ID NO: 358122 - DNA, 652 bp, Homo sapiens
  misc_feature: GZ8MTXP01CDYJQ.52.82.H05.1.454.CMB.2.raw
  modified_base (238)..(238): a, c, t, g, unknown or other
  misc_feature (238)..(238): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgtttntgtcttatcgacagacagacgccgacggccgacggtccctggttggttggtagtaattaagtaaagtaaacggactacgtaggaacggaccggtccccgtacggacgggtactcccgtagacgtcgtacttccgtcccgtcggtcctacccgacccgtacggaaacgggtacctaacgtacgtccgtacggttcgacctagtcgaggtggacgtccgaggcgaaggagggacggaggctacgacctacgacgtacgtaaccaacgtaacgaacgacgacgacgacgtaggttcgtttacttgtcgttacttcgacgtaacggtcgggaaccgtacggttccgtacccgttccgttacggttccaccggaacccgaaccgaaccccaacccgtcgttaccgtccttcccgttccg

SEQ ID NO: 358123 - DNA, 551 bp, Homo sapiens
  misc_feature: GZ8MTXP01BEAKK.52.82.H05.1.454.CMB.2.raw
  modified_base (379)..(379): a, c, t, g, unknown or other
  misc_feature (379)..(379): n is a, c, g, or t
  modified_base (460)..(460): a, c, t, g, unknown or other
  misc_feature (460)..(460): n is a, c, g, or t
  modified_base (484)..(484): a, c, t, g, unknown or other
  misc_feature (484)..(484): n is a, c, g, or t
  modified_base (510)..(510): a, c, t, g, unknown or other
  misc_feature (510)..(510): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagtatatctgtactaaaccgttatgtcttattggtaccagcaagacgccaggccacggcccctgtgttgtgatatagaagacactagagacgccctaacgagggtctcccgtgagcgtattcncgtacgcctaccacctcgacggactacgtacgtcgtacgttacgacatcgaggtcggacggtcgaggacgaggaggaccgngtcgtagacctacgatcgactaanacgaacagacgagcgttggttcgttnttaagtctcgttcgacgttacgtaaccggaacgtaaccggg

SEQ ID NO: 358124 - DNA, 651 bp, Homo sapiens
  misc_feature: GZ8MTXP01ELNP6.52.82.H05.1.454.CMB.2.raw
  modified_base (303)..(303): a, c, t, g, unknown or other
  misc_feature (303)..(303): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtacaactggtggagtcgtgggggagcgtggtccagccgtggggagtccctgagactctcctgtgcagtcctctggacttcaccttcagtacctatagtatacacgtggtccnccaggctccgtgggacaagggactgggagtgggtggctagtctatatcaaatgataggaaacaataaacccattctaacagtaaccgttaccgtaaaaggggccctaattcccaacctattcccgtaccaagacgaacctaaactttacccgaaagaaccgtacgggttacgtaccttaactaaactaaacgttagtaaacgttaggttttagaacggtacgtttaggaacggaacccgtacggtacttaggttaatttattaacgttggttgacggttacggtaaaggggtaactttacggattaagtaaggcctaacgacccgtacgaacgtaacccgaattaacc

SEQ ID NO: 358125 - DNA, 634 bp, Homo sapiens
  misc_feature: GZ8MTXP01BPBTX.52.82.H05.1.454.CMB.2.raw
  modified_base (102)..(102): a, c, t, g, unknown or other
  misc_feature (102)..(102): n is a, c, g, or t
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (307)..(307): a, c, t, g, unknown or other
  misc_feature (307)..(307): n is a, c, g, or t
tcagcgcagtacgacacgaccggtgctcgatttagtcgagctctctcgcggggtctgggagacgagcccagcactggaagtcgccggtgtttccattcggtnatcatcactgaacacagaggactcaccatggagtttgggctgagcttgggttttcctcgttgcttcttttaagaggtgtccagtgtcaggtacaacgtggtggagtcgtgggggagcgtggtccagccgtgggacgtcctgacgctctcctgtncagcctntggacttcaccttcaacgtacctatagtatacacgtgggtcccncgaggctccgtggcaagggctgggagtcgggtgctattctatacgtacaaatcgaataggaaaactaataaacccattctaacacgtactacccgggtaaagggcctaattccactactcctccgaagacgaactaaacttacccgaaagtaccgacgggttactacctactaaaccaaagttacgaaacgtagtttagaagtacgttaggacggtaacgtaccggtattagtattaacgttaacgtggttcgacggttacggtaaagggtacgtttaggttaattacgtaaggcctaacggccctacggaactaaccttaataacg

SEQ ID NO: 358126 - DNA, 692 bp, Homo sapiens
  misc_feature: GZ8MTXP01ES0JS.52.82.H05.1.454.CMB.2.raw
  modified_base (264)..(264): a, c, t, g, unknown or other
  misc_feature (264)..(264): n is a, c, g, or t
  modified_base (468)..(468): a, c, t, g, unknown or other
  misc_feature (468)..(468): n is a, c, g, or t
  modified_base (648)..(648): a, c, t, g, unknown or other
  misc_feature (648)..(648): n is a, c, g, or t
tcagcgcagtacgacacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagagagagtgtgttgggttggggagcttggtccagcctggtggttccctgagactctcctgtgcagcctgtggattccgtccgtacagtagctaactcagtgacgtcgtgggtcccncgtaggcctaccggaggggaacggctgggagtgggtcctacgaagttcgtttaagcggttacggtgtaacccacgtaattactttagcgtcgttacggaccgtacggtaggaaacggggtccctaactttccaaacctgtccgtacccgaaagggacgaacgtacgtacccgaaagggtaaacctcgtcccgttgtttacctanaaaagttcggactaggttacaggaaccgtacccgtaggaccgtacaccgggtcttacggtcttaacgttcggtacggtcgacggtaacgacccgaaccgggagggggccggatccgaccgtaccccgttagcgggtacgggcccgaaacgggttcccgtcacccgggttcttcccggacnccggccctaaccgcggtaccggttccctaaggttcccgtccccg

SEQ ID NO: 358127 - DNA, 533 bp, Homo sapiens
  misc_feature: GZ8MTXP01E4219.52.82.H05.1.454.CMB.2.raw
  modified_base (260)..(260): a, c, t, g, unknown or other
  misc_feature (260)..(260): n is a, c, g, or t
  modified_base (456)..(456): a, c, t, g, unknown or other
  misc_feature (456)..(456): n is a, c, g, or t
  modified_base (521)..(521): a, c, t, g, unknown or other
  misc_feature (521)..(521): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatattctgtacaaacgttatgcttattggtaccagcagaanccaggccaggcccctgtgttggtgatatataaaggacactgagacggccctcgagggactcccgtgagcgattctccctggctccacctcgaaagggaccaactacgtcacgttgaccatcagtggagtccaggcagaggacgaggctagacacccatgtacaacgtcaaacgagacagacaggttgttacttatntcttcgacaacgtcgggaccaaggttcaccgtcaggttcacgaacccaggtaaccccaacccgancgtccaacttcc

SEQ ID NO: 358128 - DNA, 624 bp, Homo sapiens
  misc_feature: GZ8MTXP01CJZ6E.52.82.H05.1.454.CMB.2.raw
  modified_base (182)..(182): a, c, t, g, unknown or other
  misc_feature (182)..(182): n is a, c, g, or t
  modified_base (227)..(227): a, c, t, g, unknown or other
  misc_feature (227)..(227): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (291)..(291): a, c, t, g, unknown or other
  misc_feature (291)..(291): n is a, c, g, or t
  modified_base (336)..(336): a, c, t, g, unknown or other
  misc_feature (336)..(336): n is a, c, g, or t
  modified_base (382)..(382): a, c, t, g, unknown or other
  misc_feature (382)..(382): n is a, c, g, or t
tcagcgcagtacgacacgaccggtgctcgatttagtcgagctctctcgcgggacgaccggtgctcgatttagagagagtgtgttgggtttgggggaggcttggtccagcctggtggttccctgagactctcctgtgcagcctctggattctccgtcagtagcaactacatgagctgggtccnccaggctccgaggggaagggctggagtgggtctcaagttctttangtcggtgtaccanatattangctgactcgngaggcatcacancncagagacgagtccaggaacngtccttgtttctacaaagtggactagtctagacgacctgacgacncggtctcgtctattctgtgaacgagaacgaacccggagggggcganccgacgtccccgtagtcggcgggccgacggggacccggtcacccgtctccgtcgacgccctaccgaaccgacgggcccctacggtcccggttcccttcccccgtcggcccctaccccgtccgtaccgaacgaccgtcccgtaccgtcggtcgggggaaccaacggcggcccggacccgtcggacttcggccgttacggtaaccaaggtaaccttaccgttaccttacgtaacgaacgtccgg

SEQ ID NO: 358129 - DNA, 582 bp, Homo sapiens
  misc_feature: GZ8MTXP01DVBKE.52.82.H05.1.454.CMB.2.raw
  modified_base (254)..(254): a, c, t, g, unknown or other
  misc_feature (254)..(254): n is a, c, g, or t
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
  modified_base (480)..(480): a, c, t, g, unknown or other
  misc_feature (480)..(480): n is a, c, g, or t
  modified_base (488)..(488): a, c, t, g, unknown or other
  misc_feature (488)..(488): n is a, c, g, or t
  modified_base (506)..(506): a, c, t, g, unknown or other
  misc_feature (506)..(506): n is a, c, g, or t
  modified_base (551)..(551): a, c, t, g, unknown or other
  misc_feature (551)..(551): n is a, c, g, or t
tcagcgcagtacgacacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagagagagtgtgttgggtttggggagcttggtcagcctggtgtccctgagactctctgtgcagcctctggacttctccgtcagtagcaactacatgagctgggtccncgagctcgagggaggctggagtggtctcaagttctttagngtcgtgaccatatattangctgactccgtagaacggccgtattccaactagtcctacgaagacgaacgagtcccaaagggaaactacgtccttgttttctactaaagtcgggaacagttccgtagaacgaccgtagaccgacgacgcttagttccttaagttacgtgtcgacgagaaccgaccggnggggacgncgaccgtcccgtagtcgnggggaccacggggttacccgtgaccttcgccttacgccgtacccnccgaccggacggcctaaggttcccggtcccc

SEQ ID NO: 358130 - DNA, 684 bp, Homo sapiens
  misc_feature: GZ8MTXP01C4DUS.52.82.H05.1.454.CMB.2.raw
  modified_base (239)..(239): a, c, t, g, unknown or other
  misc_feature (239)..(239): n is a, c, g, or t
tcagcgcagtacgacacgaccggtgctcgatttagtcgagctctctcgcgggggtgggtccaggaggcagaactctgggtgtctcaccatggcctggatccctctacttctcccctcctcactctctgcacaggctctgaggcctcctatgagctgacacagccatcctcggtgtcagtgtccccaggacagacggccaggatcacctgctctggatatattctgtacctaaaccgttntgtctttattggtaccagcaagagcaggccaggccctgtgttggtgatatataaggacactgagacggccctgagggctcccgtgacgcgtatttcctcgtcggtcctacccacccgtaccgaagggaacctaacgttacgtacccgtacgtttcgaacctagtccgtaggtacgggtacgtacccggagggaccgaaggggaacggggacggaagggtccgtacggtaaaccctaccctaacgttcggtaacgtaaacttacaaacgacgaacacgtcgtaggtttacggtttctttagtacggtttccgtttacggaacctaacggttacgggggaaaccccttaaaggggtcccgtaaacccggttcccggttacgggttccaaccgtaaccccggaacggtacccccaaaccccgttacgttccgttaacctttaaccccg

SEQ ID NO: 358131 - DNA, 643 bp, Homo sapiens
  misc_feature: GZ8MTXP01BE14W.52.82.H05.1.454.CMB.2.raw
  modified_base (545)..(545): a, c, t, g, unknown or other
  misc_feature (545)..(545): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctcccctcctcactctctgcacaggctctgaggccctcctatgagctgacacagcccaccctcggtgtcagtcgtccccaggacagacggccaggatcacctgctcgtggagatatctgtacctaaaccgttatgtctttagttcggtaccagcaaggaacgccgaggccacggcccctgtcggttgagatatagtaacggaccacgtgacgacggccctaacgacgggtctcccgtaggacgtcgtactttctacggtcggtccctaccgaccgttacgacgggactaacgttacgtcgtaacgttcgaaacctagtaccgaagggttcggacggtacccgaggggaccgaagggaacggacggaggtccgtacggaacctaaccgtactacggtanaaacttaccaaagacggttacacggtacaacgggtttcgtttacgttaagttcggttctttacccggacgttaacggttccgggaaccgttaaccggg

SEQ ID NO: 358132 - DNA, 612 bp, Homo sapiens
  misc_feature: GZ8MTXP01ASQ4A.52.82.H05.1.454.CMB.2.raw
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
  modified_base (339)..(339): a, c, t, g, unknown or other
  misc_feature (339)..(339): n is a, c, g, or t
  modified_base (528)..(528): a, c, t, g, unknown or other
  misc_feature (528)..(528): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtacaatggtggagtcgtgggggagcgtggtccagccgtgggagtccctgagctctctgtgcagcctgtgattcaccttnagtactatagtatacacgtgggtccncaggcctcgtggacgaagggctgggagtgggtgctatctatanacaaatgaagtacgaaactaataaaccctattccaacaggaacctaccgggtaaagggccctaattacccgaaccctatacccgtaccgaaggaacgtaaactaaacttacccgaaaagtaaccgtacggtacgtactacgtaacaaaggttgaaacgttagttacgaagtacgtagaggtacacggtntagtatacttaacgtggttgacgagaacgggtaattcggaatttacgaagtcgtaaccggtacccgtagaaaccgtccgaactc

SEQ ID NO: 358133 - DNA, 773 bp, Homo sapiens
  misc_feature: GZ8MTXP01DWFJZ.52.82.H05.1.454.CMB.2.raw
  modified_base (217)..(217): a, c, t, g, unknown or other
  misc_feature (217)..(217): n is a, c, g, or t
  modified_base (243)..(243): a, c, t, g, unknown or other
  misc_feature (243)..(243): n is a, c, g, or t
  modified_base (270)..(270): a, c, t, g, unknown or other
  misc_feature (270)..(270): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagcccacccgtggtgtcaggtcgtcccccaggacaggacggccaggatcactgctnggatattattctgtactaaaccgttntgtactttagttcggtacagcagaacnccgaggccacggccctgtgttggtagtatataagtaagacacgtaggagacggtccgtacgagggtactcccgtaggacgcgtacttcctccgtcggcctacccgtaccgtaccgtaaacggggactaaccgttaagtcccgtaacggttacgaaccctaagttacgtaagggtcgggtacgtaccgagggacgaagggaacgggaaccgggacggtctacggtaacctaccgtacgtacggtaacctaaacgtaccaaacgtaacgaacccgtaggtaaccgttaggtttacgggttttaaccttacgtttcggttacccgtttaccggtaacccgtaaaccggtacccgggggttaaaacccgttaaacccgggttacccgtaaaccccgggttccgttaacccggggttacccgaacccgggtaaacccccgaaaccggggtaaccccctaaaccccccgtacggttacccggtaaccccgttaacccgttttccccccg

SEQ ID NO: 358134 - DNA, 708 bp, Homo sapiens
  misc_feature: GZ8MTXP01BPPSZ.52.82.H05.1.454.CMB.2.raw
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (286)..(286): a, c, t, g, unknown or other
  misc_feature (286)..(286): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttcctccccctcctcactctctgcacaggctctgaggcctcctatgagctgacacacgcccacccgtcggtgtcagtcgtccccaaggacaggacggccaggactcacctgctcgngganattatctgtactaaaccgttntcgtcttagtcgtacagcgagacgccgaggcccgacggtccccgtggttcggtttggtagtacttagtaaagtaacggacccacgtaggacggacggtcccgtaacggagggtctcccgtaggacgcgttacttctcgtccggtccctacccgacccgttacgacgggtaacctacgttaacgtccgttaacggttaccgaaccgttaacgtcgaacgggttacggaaccgggtaccggaacggggaccgaaagggggaaccgggtaaccgggacggtacccgttacggaaacccttacccgtaaccgttacgtaactaaacgtaaccgaaacgaacgaacgaacgtacgttacgggttcgttttaccttgttcggttaaccttcgggaaccttacgggtaacggttaacccgttaaccggg

SEQ ID NO: 358135 - DNA, 729 bp, Homo sapiens
  misc_feature: GZ8MTXP01DIFPS.52.82.H05.1.454.CMB.2.raw
  modified_base (173)..(173): a, c, t, g, unknown or other
  misc_feature (173)..(173): n is a, c, g, or t
  modified_base (216)..(216): a, c, t, g, unknown or other
  misc_feature (216)..(216): n is a, c, g, or t
  modified_base (238)..(238): a, c, t, g, unknown or other
  misc_feature (238)..(238): n is a, c, g, or t
tcagcgcagtacgacacgaccggtgctcgatttagtcgagctctctcgcggggtgggtccaggaggcagaactctgggtgtctcaccatggcctggatccctctacttctcccctcctcactctctgcacaggctctgaggcctcctatgagctgacacagccaccctcggtntcagtgtccccaggacagacggccaggatcacctgctctgganatattctgtcaaaaccggtttntgtacttatcgacagacaagaacgcgacggccgacggcccgtgtggttggtagtaataagtaaagtaaacggacgtaacgtagaacggacggtcccctacgaacgggtacctccgtagacgacgtacgttctccgtcgtctacccgtaccgtacgaaacggtactaacgtacgtacgtaccgttacgaaccgtactacgtaagtcggacgtaccgaacgggacgaagggaggaacggtaggcgtacgaaccgttaacctactacgtaaacaaacgtaacgaaacgaacgaacgaacgtacgtaggttacggtttacgtttacgttacgttaccgttaccgtaacgtaaacggtaacgggttaaaccggtaaacggttaccgtaacccggttaacccggttaaccggttaccgttaacccgtaacccggaaaccccggtaaccccgtaaaccccgtaacccgttaccgttaacccgttaacccgttaacccg

SEQ ID NO: 358136 - DNA, 628 bp, Homo sapiens
  misc_feature: GZ8MTXP01A0ZT8.52.82.H05.1.454.CMB.2.raw
  modified_base (203)..(203): a, c, t, g, unknown or other
  misc_feature (203)..(203): n is a, c, g, or t
  modified_base (348)..(348): a, c, t, g, unknown or other
  misc_feature (348)..(348): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggntcacctgctcgtggagattattctgtactaaaccgtttatgtctttagttcggtaaccagcaggaacgccgaaggcccaggtcccctgtggttggtagataataagtaaggacacgtagacggacggccctacgagggactccgngacgacgtattctccgtcggctcccacctacgaaagggaccctaacgtagtaccgtacgttacgaccaagtccgaggtacggacgtccgacgggacaaggaggacccggaggtacacggacctaccgacgtgtaccaaactacgaaacgacgacgacgtacgtaggtttcgttactttagtcgttacttcgacctaagtcgggaaacctaacggttccgtaccgtcgttacggttcacgtaaccacggaacccaacccctgttacctccaacgtttcccc

SEQ ID NO: 358137 - DNA, 758 bp, Homo sapiens
  misc_feature: GZ8MTXP01EZI7T.52.82.H05.1.454.CMB.2.raw
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtcgtcccccaggacagacggccaggatcacctgctctggagattattctgtacaaaccgttatgtctttattcggtacagcagaacgccgaggccaggcccctgtgttggtgatataagtaaggacacgtgagagccctcgagggactccgtagagcgtattccgtcgtcggcctaccgaacccttcggaaacgggacctaacgttacgtaccgacgtttcgaacctgtacgacggttgggaacgtaccggagggcgaagggagggaacccgggagggtacctacggtaaaccgttacccaacgttacggtaacctaaacgttaacaaaccgtaacgaacgaacggtacccgttaaaggtttcgggttttttaacccgtttaagttacggttttcccgttaccggtaaccggtaaacccgttaacgggggttaaaccccggtaacgggttaccccggtaaacccggttaccgttaaccgggggttaacccaacccggggtaacccccgtaaacggggtaaccccccgaaaaccccccgtaactttcccgggtaaccccgttaacccgttttaaccccgg

SEQ ID NO: 358138 - DNA, 620 bp, Homo sapiens
  misc_feature: GZ8MTXP01C89LV.52.82.H05.1.454.CMB.2.raw
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtacaactggtggagtcgtgggggagcgtggtccagcctgggagtcctgagctctcctgtncagcctntgattcaccttcagtactatagtatacacgtggccncaggcctccgnggacgaagggactgggaggtggggtgctatctatatacaaatgaatagaaaactaataaaccctatttcaaacgaacgtaaaccgtaccgggtaaacgggcctaattacccacctatcctaccaagaacgtaaacaaattacccaaagaaccgtaacgggttctactaactaaacaaaggttacgaaacgttagtttagaaacgttaccgttaggaacggaaccgtacggtattagtaattagtttaacgtgttcggacgttaggtaaaggttattacgttattagaacgacaacgacccacgaactcaactaa

SEQ ID NO: 358139 - DNA, 561 bp, Homo sapiens
  misc_feature: GZ8MTXP02GJEI7.52.82.H05.1.454.CMB.2.raw
  modified_base (237)..(237): a, c, t, g, unknown or other
  misc_feature (237)..(237): n is a, c, g, or t
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (304)..(304): a, c, t, g, unknown or other
  misc_feature (304)..(304): n is a, c, g, or t
tcagcgcagtacgacacgaccggtgctcgatttagtcgagctctctcgcggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgtttntgtcttatgtacagcagagcagcacgcctgtgtgnatatanagacangagacgcctgaggactccgngagcgtattctccgtcgcctccacctcgacggacacgtacgtcgtacgttacgacctatcgaggtacgacgtaccgaggacgaggaaggacgacggtctacgaacctaccacgtagtacaaactacaaacgagacagtacgaggttcggtttacttagtcgtcttacgacgtaacgtacgggaacctaacggtaccaccgtacgtacggtaccaacgaacccgaacggaccccaaacccgacgtcgtacctactccg

SEQ ID NO: 358140 - DNA, 532 bp, Homo sapiens
  misc_feature: GZ8MTXP02G1CFR.52.82.H05.1.454.CMB.2.raw
  modified_base (372)..(372): a, c, t, g, unknown or other
  misc_feature (372)..(372): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (420)..(420): a, c, t, g, unknown or other
  misc_feature (420)..(420): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtacaactggtggagtcgtgggggagcgtggtccagcctgggagtccctgagactctcctgtgcagcctctggattcaccttcagtacctatagtatacacgtgggtccgccaggctccgtggccaaggggctgggagtggggtggcatctatatcaaatgataggaaacataaccattctanagactcgtaaagggcatcaccatcncaganacatccaagaacacggtntactactaacaaatgaaactagtttagaagtacttgaggacacggctagtatattactgtagcgacggagggtaattcgaatttagaagactacgccctagaacgaccatac

SEQ ID NO: 358141 - DNA, 633 bp, Homo sapiens
  misc_feature: GZ8MTXP02GJ9FK.52.82.H05.1.454.CMB.2.raw
  modified_base (237)..(237): a, c, t, g, unknown or other
  misc_feature (237)..(237): n is a, c, g, or t
tcagcgcagtacgacacgaccggtgctcgatttagtcgagctctctcgcggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcatctgctctggagatattctgtcaaaccgtttntgtcttagttcggtacagacaagacgcgacggccacggccctgtgtgtgatatagaagacatgagacgcctagaggactccagagcgtacttccgtcgtcggcctaccacctcgaacgggacctacgtacgtaccgtaccgttacgaacctagtacgaggtacggacgtaccgaggacgaaggacggacgtacggactacgaacccgtaaccgtacgtcgtaaacctaaacgtaccaaaacgacggaaacgtaacgacgtaggttcggtttacttagttacgttcgtacgacgtaacggtaggaaaccgtaaacggtaccacccgttaccgtaacggtaccaaccggtaaccccgaaaacggaccccctaaaccccgtacgtaccgtaccctaacg

SEQ ID NO: 358142 - DNA, 503 bp, Homo sapiens
  misc_feature: GZ8MTXP02FR7VH.52.82.H05.1.454.CMB.2.raw
  modified_base (354)..(354): a, c, t, g, unknown or other
  misc_feature (354)..(354): n is a, c, g, or t
  modified_base (451)..(451): a, c, t, g, unknown or other
  misc_feature (451)..(451): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggaccactgagaggccctcgagggntccctgagcgattctctggctccacctcagggacacgtagcacgttgaccatcagtgagtccaggcagagacgaggctgacacatgtcaatcaaacngaacagcaagtggttactaagtcgttcttacgactaacgtcggacctaacgg

SEQ ID NO: 358143 - DNA, 580 bp, Homo sapiens
  misc_feature: GZ8MTXP02JK7RB.52.82.H05.1.454.CMB.2.raw
  modified_base (301)..(301): a, c, t, g, unknown or other
  misc_feature (301)..(301): n is a, c, g, or t
  modified_base (377)..(377): a, c, t, g, unknown or other
  misc_feature (377)..(377): n is a, c, g, or t
  modified_base (428)..(428): a, c, t, g, unknown or other
  misc_feature (428)..(428): n is a, c, g, or t
  modified_base (438)..(438): a, c, t, g, unknown or other
  misc_feature (438)..(438): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtacaactggtggagtcgtgggggagcgtggtccagcctgggagtccctgagactctcctgtgcagcctctggacttcacttcagtacctatagtatacactgggtcccncaggcctccgtggcaaggggctgggagtggggtgcatctaatatacaaaatgaataggaaaacataaccattcaanagacctaccgtaaaggccatcactatcacagacacaatccaaagacacggntctactaaanaaatagaactagttacgaagtacgtaggaacggacgtacggtcttagtaacttacgttacgtggtacggacggtaggtaaacgggtaacttacgtaaattacgaacgaccgaaccgtaccctaacggaaacgtaccaagtac

SEQ ID NO: 358144 - DNA, 541 bp, Homo sapiens
  misc_feature: GZ8MTXP02IPYP6.52.82.H05.1.454.CMB.2.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (328)..(328): a, c, t, g, unknown or other
  misc_feature (328)..(328): n is a, c, g, or t
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatattctgtcaaaccgttntgcttatggtaccagcagaagccaggccaggcccctgtgtggtgatatataaggacactgagaggccctgagggactccctgagcgattcnctgcctccactcaggacnctgcacgttnaccatcagtgagtccagcagaggacgaggctagactaccatgtaccaaatcaaacagacagaccaagttcggtttactagtgtcttcgactaaacgtgggaacctaaaggtccaaccgttccgtaacggtccaacggaaccccgaaaggacccctaaaacccccatccgtactaaccgtttcccg

SEQ ID NO: 358145 - DNA, 476 bp, Homo sapiens
  misc_feature: GZ8MTXP02FVWYQ.52.82.H05.1.454.CMB.2.raw
  modified_base (371)..(371): a, c, t, g, unknown or other
  misc_feature (371)..(371): n is a, c, g, or t
  modified_base (467)..(476): a, c, t, g, unknown or other
  misc_feature (467)..(476): n is a, c, g, or t
tcagcgcagtacgacacgaccggtgctcgatttagtcgagctctctcgcgggcacgaccggtgctcgatttagatcgtctgtgttgggtttgggtccggcagccccccgggaagggcctggagtggattggagatatctactacagcggggcaccagctacagtccctccctcaagagtcgagttggcatatcaatagacacgtccaagaatcagttctccctgaagctgaaatctatcattgtgcggacacggccgtctattattgtgcgagacatggcagcccatatagtcgctggttcgacccctggggcccggaatcccggtcaccgtctccccagctccaccaggcccccatcggtctcccctgcncctgctcagagcactcgtggggcacagcggccctgggctgcctggtcaaggactacttcctatacgatcgctgagcgggctggcaaggcgcatagnnnnnnnnnn

SEQ ID NO: 358146 - DNA, 515 bp, Homo sapiens
  misc_feature: GZ8MTXP02I1XI7.52.82.H05.1.454.CMB.2.raw
  modified_base (237)..(237): a, c, t, g, unknown or other
  misc_feature (237)..(237): n is a, c, g, or t
  modified_base (352)..(352): a, c, t, g, unknown or other
  misc_feature (352)..(352): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttntgcttattggtaccagcagaagccaggccaggcccctgtgttggtgatatataaggacactgagacggccctcagggactccctgagcgattctcctggcctccactcagggacnctagtcacgttgaccatcagtgagtcaggcagaggacgaggctagacctacactgacaaatcaaacagacagcagtgttctatgtcttcgacacgtgggaaccaaggtccaccgtctacggtcacgaacccgaacggacccaaccccgactcgtaccacttcc

SEQ ID NO: 358147 - DNA, 523 bp, Homo sapiens
  misc_feature: GZ8MTXP02HCGUW.52.82.H05.1.454.CMB.2.raw
  modified_base (317)..(317): a, c, t, g, unknown or other
  misc_feature (317)..(317): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcactgctctggagatattctgtcaaaccgttatgcttatggtaccagcagaagccaggccaggcccctgtgttgngatatataaggaccactgagacggccctacgaggggactcccctgacgcgattctcgtggcctccacctcaggggacacgtagtccacgttgacccatcgaagtggagtccgaggacaggagacgaggctagactaccacgtgtacaatcaaacacggacaggcaggtgttctaagtcgttcttacgacaacgtcggaactaacgg

SEQ ID NO: 358148 - DNA, 561 bp, Homo sapiens
  misc_feature: GZ8MTXP02J2SPB.52.82.H05.1.454.CMB.2.raw
  modified_base (226)..(226): a, c, t, g, unknown or other
  misc_feature (226)..(226): n is a, c, g, or t
  modified_base (257)..(257): a, c, t, g, unknown or other
  misc_feature (257)..(257): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (344)..(344): a, c, t, g, unknown or other
  misc_feature (344)..(344): n is a, c, g, or t
  modified_base (477)..(477): a, c, t, g, unknown or other
  misc_feature (477)..(477): n is a, c, g, or t
tcagcgcagtacgacacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagagagagtgtgttgggtttggggagcttggtccagcctggtggttccctgagactctcctgtgcagcctctggattcnccgtcagtagcaactacatgagctgggtccncaggctccgagggaggctggagtggtctcaagtctttagngtcgtgtaccatatattangctgactcgagacggcctatccacatcncagacgcgactaccgaggacagccctttgtttcctacaaagtcggaactaggtccagacgtaccctaggaccgaacgcggtctcggttaccttagtacgtgtacgcggtaagaccgacccggagggggcgacnctaccgcccgtaatcgacggggccacggggacccgtcacccgtctccgagaacgtccctacgaccgacggccagtcccggtccc

SEQ ID NO: 358149 - DNA, 546 bp, Homo sapiens
  misc_feature: GZ8MTXP02IPYOE.52.82.H05.1.454.CMB.2.raw
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (325)..(325): a, c, t, g, unknown or other
  misc_feature (325)..(325): n is a, c, g, or t
  modified_base (364)..(364): a, c, t, g, unknown or other
  misc_feature (364)..(364): n is a, c, g, or t
  modified_base (413)..(413): a, c, t, g, unknown or other
  misc_feature (413)..(413): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttntgcttatggtaccagcagaancagccagcccctgtgtggtgatatataaggacactgagaggccctcgagggatccctgagcgattcnctggctccacctcagggacactagtcaacgttgacctancagtgagtccagcagaggacgaggctgaactaccatgtacaatacaaanagacagacgtagtgttactagtcgttacgtacgacgtaacgtacggaaccgtaacggtaccgtaccgttaccgtaacggtcaaccgaacccgaaaccggacccaaacccccgtacgtacgtacctaccgtccg

SEQ ID NO: 358150 - DNA, 500 bp, Homo sapiens
  misc_feature: GZ8MTXP02JREIN.52.82.H05.1.454.CMB.2.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (342)..(342): a, c, t, g, unknown or other
  misc_feature (342)..(342): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatattctgtcaaaccgttntgcttatgtacagcagagcagcagccctgngtgnatatataaggacactgagaggccctgagggactcccgtgagcgattctccgtggcctccactcgagggacnctagtcacgttgaccatcagtgagtccagcagacggacgaggctacggactaccgattagacaatcaacgagacagcagtgttactagtgtctgctaacgtggacctaaggccaccgtctacggcacgcccgaacggcccaaccacgtcgtacactcc

SEQ ID NO: 358151 - DNA, 601 bp, Homo sapiens
  misc_feature: GZ8MTXP02GZYHY.52.82.H05.1.454.CMB.2.raw
  modified_base (236)..(236): a, c, t, g, unknown or other
  misc_feature (236)..(236): n is a, c, g, or t
  modified_base (329)..(329): a, c, t, g, unknown or other
  misc_feature (329)..(329): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatattctgtcaaaccgttntgcttattggtaccagcagagcaggccaggcccctgtgttggtgatatataaggacacgtgagaggccctgagggactccctgacgcgattcnccgtcggccctactactacggacgactacgtacgtacgtacgtaccactactacgtaggtacgtaccgaccggacgacggaagggaacggaacggacgtacgtaaccgtaaccctaacctacgttacgaactaacgaaccaaagacgaacgagacgtaggtttcgttacttacgttcgttacgtcgaacgtaacggaccggtaaacgtacgtaccgtaccgtacgtacgacgaccgaaccgaccgaacccaccgtactacgacctacctccg

SEQ ID NO: 358152 - DNA, 598 bp, Homo sapiens
  misc_feature: GZ8MTXP02FWEZQ.52.82.H05.1.454.CMB.2.raw
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (279)..(279): a, c, t, g, unknown or other
  misc_feature (279)..(279): n is a, c, g, or t
  modified_base (357)..(357): a, c, t, g, unknown or other
  misc_feature (357)..(357): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatattctgtacaaaccgttntgcttattggtaccagcagaagcagccaggccctgtgttgngatatataaggacactgagacggcccctgagggactcccgtgagcgtattctccgtgcctccaccttcgaggggaccncgtagtcctacgttacgaccctatccaggttgagtccaggacaggaggacgaggctagacctaccatgtacaatacaacagaccagacctaaggttggttacttagtcgtacttacgactaacgttcgggaaaccaacgggttcccaacccggttaccgttaacggggtcccaaaccggaacccccgaaaacgggaccccctaaaacccccgacgttaccggtaccctaactttcccccgg

SEQ ID NO: 358153 - DNA, 635 bp, Homo sapiens
  misc_feature: GZ8MTXP02HY0UT.52.82.H05.1.454.CMB.2.raw
  modified_base (260)..(260): a, c, t, g, unknown or other
  misc_feature (260)..(260): n is a, c, g, or t
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtacaactggtggagtcgtgggggagcgtggtccagcctgggagtccctggagactctctgtgcagcctcnggattccaccttcagtacctatagtatacacgtgggtcccncaggcctccgnggcaagggctggagtgggtgcatctatatacaaatgaataggaaaactaataaaccatttcctaacaagtacctacccgggtaaaagggccctaaattcccaacctatccctaccaagtacgaactaaacttaccaaagaaaccacgggtatacctacttaaacaaagttagaaactaggtttagaagtaacgttggaacggacgtacgggtacttaggtaacttaagtttacgtggtacggacgtaacgggtaaggggtaaacttcggtaattaagtaacggctaacggtacccccgttaaggaaaacgtaccctaagtccg

SEQ ID NO: 358154 - DNA, 553 bp, Homo sapiens
  misc_feature: GZ8MTXP02F9PIJ.52.82.H05.1.454.CMB.2.raw
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtacaaaccgttatgtcttatggtaccagcagaagcaggccaggcccctgtgtggtgatatataaggaccactgagacggccctacgagggctccctgacgcgtattctcgtggcctccaccctcgaacgggacacgtacgtctacgttacgaccatcgagttggacgtccgaggcaggaggacgaggctaggacctaccaacgtgtacaacgtacaaacgacgaacacgtacctaacggttggtttaccttaagtcgttacttacggactaacgtcggaacctaaacgg

SEQ ID NO: 358155 - DNA, 549 bp, Homo sapiens
  misc_feature: GZ8MTXP02HB1KW.52.82.H05.1.454.CMB.2.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
  modified_base (362)..(362): a, c, t, g, unknown or other
  misc_feature (362)..(362): n is a, c, g, or t
  modified_base (386)..(386): a, c, t, g, unknown or other
  misc_feature (386)..(386): n is a, c, g, or t
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
tcagcgcagtacgacacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagagagagtgtgttgggtttggggagcttggtccagcctggtggttccctgagactctcctgtgcagcctntggattctccgtnagtagcaactcatgagctgggtccncaggctccgagggaagggctggagtggtctcaagtctttatgtcggtgtaccanatattangctgactcgtgaaggcattcaccatctcagagcgatccaggaacngcctgttctacaaatggacagtcngacacctgacgacacgctagtctattacgtgngacgagacgaacccgngggggccgagtccagacccccgtaagttcgacggggaccgacggggaaccccggtcaacccgtctcccgtgaacgcccacccgaccgaacgggccccctaagtccggttaccccg

SEQ ID NO: 358156 - DNA, 631 bp, Homo sapiens
  misc_feature: GZ8MTXP02F5J1M.52.82.H05.1.454.CMB.2.raw
  modified_base (279)..(279): a, c, t, g, unknown or other
  misc_feature (279)..(279): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttcctccccctcctcactctctgcacaggctctgaggcctcctatgagctgacacagcccaccctggtgtcagtcgtccccaggacagaccggccaggatcacctgctctggagatattctgtacaaaccgttntgcttattcggtaccagcaagaacgcaggccaggcccctgtcgttggtagatataagtaaggaccacgtgagacggtccctacgagggctcccgtagacgtcgattctcgtcggtccctccacccgtcgaacgggtacctaacgtagtcctacgttcgaccatcgaagggttaggacgttccggaggacgaagggaacgggaaccggaggcgtacggaactacccgaagtttcggaactaaaactcccgaaaagaacggaaaccgaggtacctaaagggttcggttttaacttaacggttcgttaccgtttaccggacgttaaaccggtacggggtaacccgtaaaaccggg

SEQ ID NO: 358157 - DNA, 724 bp, Homo sapiens
  misc_feature: GZ8MTXP02G31F8.52.82.H05.1.454.CMB.2.raw
  modified_base (462)..(462): a, c, t, g, unknown or other
  misc_feature (462)..(462): n is a, c, g, or t
tcagcgcagtacgacacgaccggtgctcgatttagtcgagctctctcgcgggcacgaccggtgctcgatttagtcgagctctctcgcgggcacgaccggtgctcgatttagtcgagctctctcgcgggcacgaccggtgctcgattttagacgagagtgtgttgggttggggagcttggtccagcctggtggttccctgagactctcctgtgcagcctgtggattctccgtcagtacgctaaactacgagtcgagccgttggggtcccgcccgtaagggcccttacccgaaggggaaacggggcttagggagtcgggtacctccgaaaggttcctttaagcggttcggtacgtaaccccagtaattattaagtcgactgaacctccggtagaaacggggtcctaactttccgaaccctagttcctaccgaaggacgaccgtacgtacccaaaggggaaaccncgtccctttagtttaccctaacgtaaacgtcggaacacgtcgtaacggaaccgtacccgaggtaaacccgaccgaccggtcttacgtacttaacgttacgtcggtacgaccggaaacgaaccggtaacccgggagggggaccgacgaccgaccgtaccccgttaacgtccggacgggacccgtaaccggggacccggtcgacccgttccaccgtacgaaccgtccctaaccggacccgtacggaccctacgtcccggtcccg

SEQ ID NO: 358158 - DNA, 593 bp, Homo sapiens
  misc_feature: GZ8MTXP02HUVX9.52.82.H05.1.454.CMB.2.raw
  modified_base (280)..(280): a, c, t, g, unknown or other
  misc_feature (280)..(280): n is a, c, g, or t
  modified_base (348)..(348): a, c, t, g, unknown or other
  misc_feature (348)..(348): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacgccaggatcacctgctctggagatattctgtacctaaaaccgtttntcgtacttagtacgtaccagacgaagacgccgacgccgacggcctgtgttgagtatatagagaccagngagcgccagacggctcgagacgtcgtacttcgtcgtcgcctacccaccgtacgaacggtacctacgttacgtaccgtacgtacgaacctatacgaggtacgtacgtacgaggacgaagggacggacgacgcgtacgaacctaccgtacgtacgtaactaactacgaaacgacgaacgacgtacgtacgttcgtttacttaacgttcgtaccgttaccgaacgtaaccggtacggtaaccgtacgg

SEQ ID NO: 358159 - DNA, 679 bp, Homo sapiens
  misc_feature: GZ8MTXP02FYVT7.52.82.H05.1.454.CMB.2.raw
  modified_base (217)..(217): a, c, t, g, unknown or other
  misc_feature (217)..(217): n is a, c, g, or t
  modified_base (264)..(264): a, c, t, g, unknown or other
  misc_feature (264)..(264): n is a, c, g, or t
  modified_base (405)..(405): a, c, t, g, unknown or other
  misc_feature (405)..(405): n is a, c, g, or t
tcagcgcagtacgacacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagagagagtgtgttgggtttggggagcttggtccagcctggtgttccctgagactctcctgtgcagcctntggattcgtccgtcagtagcaactacatgacgcttgggggtaccccncgaggtcctaccggaaggggagggctagggagtcggtctacgtaagtttctttagcggtcggtacgtaaccatattattagcgctagtacctcggagacggtcctattccactatcacagacgcgacgtaccgaaggaccngtcctttagtttactaacgaaagtcggactagtcgtagaccgtaccgtaggaaccgacgaccggtcttacgttacttacgttacggtggtacggaccggaacgaacccggaacccggggagggggaccgaacgcccgtaaccggtacccccggttaagttccggggaccgggggacccgtaaccgggggtaaccccgtctacccggttcctacccgtacgaaccgtcccccgtaaccgaacccggtacggtcccctacggttccccggtccccg

SEQ ID NO: 358160 - DNA, 587 bp, Homo sapiens
  misc_feature: GZ8MTXP02IEFRW.52.82.H05.1.454.CMB.2.raw
  modified_base (264)..(264): a, c, t, g, unknown or other
  misc_feature (264)..(264): n is a, c, g, or t
  modified_base (305)..(305): a, c, t, g, unknown or other
  misc_feature (305)..(305): n is a, c, g, or t
  modified_base (316)..(316): a, c, t, g, unknown or other
  misc_feature (316)..(316): n is a, c, g, or t
  modified_base (350)..(350): a, c, t, g, unknown or other
  misc_feature (350)..(350): n is a, c, g, or t
  modified_base (378)..(378): a, c, t, g, unknown or other
  misc_feature (378)..(378): n is a, c, g, or t
  modified_base (406)..(406): a, c, t, g, unknown or other
  misc_feature (406)..(406): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtacaactgggtggagtcgtggggggagcgtggtccagccgtgggaggtccctgagactctcctgtgcagccctntggattcaccttcagtacctatagtatacacgtgggtcccncaggcttccgnggacgaagggcgtgggaggtgggtgcatctatanacaaatgatagaaacaataaccattcanagtaacctaccgtaaggctatccaccanctacgagaacaactaactaccgaaagaacgtacggtatactactaaactaaatacgtaactagtttagagtacgtaggaacggtacgacggtacttagtaattacgttacgtaggtagacggacgggtaaggtacttacgtattaagtaacgacgaccgtaccgtacgaaacgacctatac

SEQ ID NO: 358161 - DNA, 506 bp, Homo sapiens
  misc_feature: GZ8MTXP02HB7FI.52.82.H05.1.454.CMB.2.raw
  modified_base (260)..(260): a, c, t, g, unknown or other
  misc_feature (260)..(260): n is a, c, g, or t
  modified_base (310)..(310): a, c, t, g, unknown or other
  misc_feature (310)..(310): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (388)..(388): a, c, t, g, unknown or other
  misc_feature (388)..(388): n is a, c, g, or t
  modified_base (412)..(412): a, c, t, g, unknown or other
  misc_feature (412)..(412): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtacaaaccgttatgcttattggtaccagcagaanccaggccaggcccctgtgttggtgatatataaggacactgagaggccctnagggatccctgagcgattctctgctccacctnagggacnctagtcacgttgaccatcagtgagtccagcagaggacgnggctgacctacatgtacaatcaanagacagcagttggttcttagtgtcttcgctaactgggaaccaaaggtccacgtcgtagtcacgccgaacggccaaacccagtcgtacacttccg

SEQ ID NO: 358162 - DNA, 368 bp, Homo sapiens
  misc_feature: GZ8MTXP02IO7KB.52.82.H05.1.454.CMB.2.raw
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (276)..(276): a, c, t, g, unknown or other
  misc_feature (276)..(276): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
  modified_base (322)..(322): a, c, t, g, unknown or other
  misc_feature (322)..(322): n is a, c, g, or t
  modified_base (324)..(324): a, c, t, g, unknown or other
  misc_feature (324)..(324): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
  modified_base (332)..(332): a, c, t, g, unknown or other
  misc_feature (332)..(332): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (338)..(338): a, c, t, g, unknown or other
  misc_feature (338)..(338): n is a, c, g, or t
  modified_base (340)..(340): a, c, t, g, unknown or other
  misc_feature (340)..(340): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
  modified_base (356)..(356): a, c, t, g, unknown or other
  misc_feature (356)..(356): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (368)..(368): a, c, t, g, unknown or other
  misc_feature (368)..(368): n is a, c, g, or t
tcagcgcagtacgacacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagacagtatatatccgcgggcacgaccggtgctcgatttagacagtatatagtccgcggcacgaccggtgcgtcgatttagacagtatatatccgcggcgtgcgagcgcatagcggngngngngngngngngcgngngngagngngngngngngngngngngngngngcgngcgngngngngngngngngngngngcgngngngngngngngngngcgngn

SEQ ID NO: 358163 - DNA, 551 bp, Homo sapiens
  misc_feature: GZ8MTXP02F4EXW.52.82.H05.1.454.CMB.2.raw
  modified_base (354)..(354): a, c, t, g, unknown or other
  misc_feature (354)..(354): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtacaaaccgttatgcttattggtaccagcagaagccaggccaggcccctgtcgttggtgatatataaggacactgagaggccctcgagggactcccgtgagcgattctcctgctaccacctcaggacncgtagcacgttcacctatcagtgagtccaggcaggaggacgaggctagactaccactagtacaacgtcaaacagaacagacagttggttactttagtcgtacttcgactaacgtcgggaacctaaagggttccaaccggtccgtaacggtccaacggcccaaccggacccaaccccacgtacgtccaccgtttcccg

SEQ ID NO: 358164 - DNA, 588 bp, Homo sapiens
  misc_feature: GZ8MTXP02I9TLS.52.82.H05.1.454.CMB.2.raw
  modified_base (570)..(570): a, c, t, g, unknown or other
  misc_feature (570)..(570): n is a, c, g, or t
  modified_base (572)..(573): a, c, t, g, unknown or other
  misc_feature (572)..(573): n is a, c, g, or t
  modified_base (575)..(588): a, c, t, g, unknown or other
  misc_feature (575)..(588): n is a, c, g, or t
tcagcgcagtacgacacgaccggtgctcgatttagtcgagctctctcgcgggcacgaccggtgctcgatttagatcgtctgtgttgggtttgggtccggcagccccccgggaagggcctggagtggattggagatatctactacagcggggcaccagctacagtccctccctcaagagtcgagttggcatatcaaatagacacgtccaagaatcagttctccctgaagctgaaatctatcattgtgcggacacggcctctattattgtgcgagacatggcagccccatatagtcgctggtccgaccccgtggggccccggaatccccggtcaccgtcctccccagccttccaccgaacggccccccatccggtccttcccccgtggcccgcccctggcctcccgaagggacgcctacccgtcgtcgggggcccaccgacggcccgggcccgtcgggggcctcggccccgtgggtacccgaaacgggtaccctaacctttacccgtaacttaacggacttccggccgttaggaacggtccggggacgtcgggacgaacgggccgcagtagngnncnnnnnnnnnnnnnn

SEQ ID NO: 358165 - DNA, 495 bp, Homo sapiens
  misc_feature: GZ8MTXP02FE6ZA.52.82.H05.1.454.CMB.2.raw
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
  modified_base (460)..(460): a, c, t, g, unknown or other
  misc_feature (460)..(460): n is a, c, g, or t
  modified_base (483)..(483): a, c, t, g, unknown or other
  misc_feature (483)..(483): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctacacaggctctgaggcctcctatgagctgacacagccaccctcggtgtcagtgtccccaggacagacgccaggatcacctgctctggagatattctgtcaaaccgttatgcttattggtaccagcagaagccaggccaggccccctgtgttggtgatatataaaggacactgagaggccctcagggatccctgagcgattctctggctccactcagggacactagtcacgttgaccatcagtggagtccaggcagaggacgaggctgactacactgtacaancaacngacagcagtggtcttatgtcttggaactgacgacaggtcacgtcngggtcagccaaggccaaaccccnctcgcactctcg

SEQ ID NO: 358166 - DNA, 608 bp, Homo sapiens
  misc_feature: GZ8MTXP02J3IHF.52.82.H05.1.454.CMB.2.raw
  modified_base (210)..(210): a, c, t, g, unknown or other
  misc_feature (210)..(210): n is a, c, g, or t
  modified_base (322)..(322): a, c, t, g, unknown or other
  misc_feature (322)..(322): n is a, c, g, or t
  modified_base (327)..(327): a, c, t, g, unknown or other
  misc_feature (327)..(327): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctcccctctcactctctgcacaggctctgaggcctcctatgagctgacacagccaccctggtntcagtcgtccccaggacagacggccaggatcacctgctctggagatattctagtacaaaccgttatgtctttattggtaccagacagaacgcacggccaggcccctgtgtgngatanataagcactgacgngcctgagggcnccgtgagcgattcctcgtcggcctacccacgtcgaacgggacactaggtcacggttacaacccgtatccgaaagggttgacgtccgaggaccagggacggaccgagggtcctacggaaccttacccacgttacgtaaccaaactaccgaaacaacggtaacacggaccgacgggtttacgggtttaccctttaaggttccgtttaccgtttaccggaaccgttaaaccggttaacggggaacccgttaaaccgggg

SEQ ID NO: 358167 - DNA, 604 bp, Homo sapiens
  misc_feature: GZ8MTXP02JKV0Q.52.82.H05.1.454.CMB.2.raw
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggantatctgtacaaacgttntgcttatggtacagcagaagcaggccacggcccctgtgttggtgatatataaggacactgagacggccctcgagggactcccgtgacgcgtacttcgtccgtggccttccacctcgacgggacacgtacgtctaaccggttcgaaccctatacgaggttcgggactcccgaagggccgaaggacgggaacggacgggcttacggaccttaacccaacgttcgactaaataccgaacaacggacagactaggttacggtttctttaagtcgttaccgtttcgacttaacgttcggggaaccctaaagggttccaaccggttccgtacggtcacggaaccgaacggaccaaaccccactcgacctactcg

SEQ ID NO: 358168 - DNA, 555 bp, Homo sapiens
  misc_feature: GZ8MTXP02F38IL.52.82.H05.1.454.CMB.2.raw
  modified_base (240)..(240): a, c, t, g, unknown or other
  misc_feature (240)..(240): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagattattctgtacaaaccgtttntgtctttattcggtaccagcaagaacgccaggccacggccctgtgttggagtatatagtaaggacacgtgagacggccctacgagggactcccgtgagcgtattctctggcctcacctcgacggacacgtatctacgttcgacctatcgagtgacgtccgaggcaggacgacgaggctacgactaccagttacgtacaaactacaacgagaacagactaggttgttacttatcgttacgttcgacgtaacgtcgggaccaaggtcctacgtccgtaacgcacgaaccgacgacccaacccactcgcctacttccg

SEQ ID NO: 358169 - DNA, 617 bp, Homo sapiens
  misc_feature: GZ8MTXP02IQGST.52.82.H05.1.454.CMB.2.raw
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatattctgtacaaaccgttatgcttattggtaccagcaagagccacggccacggcccctgtgttggtgatatataaggaccacgtgagacggccctacgaggggactccctggacgcgtattcgtcgtggcctccaaccctcgaacggggacctacgtagtccctacgttcgaaccactacgaggtcggaacgtccgaaggaccgagggaacggacggaggtacgtacggtaaacctacccgtaacgttcgaaccctaaaactacgaaacgaacgaaacgacggacgttacggtttacgtttacttaacgttcgtttaccttaccggtaccgttaaccggtaccgggtaaccgtaaacggg

SEQ ID NO: 358170 - DNA, 638 bp, Homo sapiens
  misc_feature: GZ8MTXP02HGIBD.52.82.H05.1.454.CMB.2.raw
  modified_base (300)..(300): a, c, t, g, unknown or other
  misc_feature (300)..(300): n is a, c, g, or t
  modified_base (334)..(334): a, c, t, g, unknown or other
  misc_feature (334)..(334): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagctggggttttcctcgttgctcttttaagaggtgtccagtgtcaggtacaactggtggagtctgggggagcgtggtccagcctgggaggtccctgagactctcctgtgcagcctctggattcaccttcagtacctatagtatacacgtgggtccncaggcctcctggcaaggggctgggagtgggtggnatctatatacaaatgataggaaaactaataaacccattctaacagtaacctaccggtaaaagggccgtaattccaaccactcctaccaagacgaactaaattcccaaagaacacggtagtacctactaacaaatacgtaactagtttacgagtaaccgttggaaacggtacgtaacgggcttaggtaaatacgtttaacgtaggttggaccggtcgggtaaacggggtaatttaccggtaaatttaaagtaacggtaccgtaaccggaccccggttaacgaaaacgtaaccccgtaataacccg

SEQ ID NO: 358171 - DNA, 519 bp, Homo sapiens
  misc_feature: GZ8MTXP02J0PUK.52.82.H05.1.454.CMB.2.raw
  modified_base (314)..(314): a, c, t, g, unknown or other
  misc_feature (314)..(314): n is a, c, g, or t
  modified_base (353)..(353): a, c, t, g, unknown or other
  misc_feature (353)..(353): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacgccaggatcacctgctctggagatattctgtacaaaccgttatgtcttattggtacagcagagccaggccaggcccctgtgttggtgatatataaggacactgagaggccctgagggntccctgagcgattctccgtggctccacctcgacgggacnctagcacgttgaccatcagtgagtccgaggcaggaggacgaggctagactaccatgacaatcaacagacagcaggtgttacttatcgtcttcgactaacgtcgggaccaacgggtccaccgtacgtacgtcacgccgaacggacccacccactcgtacacttcccg

SEQ ID NO: 358172 - DNA, 514 bp, Homo sapiens
  misc_feature: GZ8MTXP02FPNDD.52.82.H05.1.454.CMB.2.raw
  modified_base (237)..(237): a, c, t, g, unknown or other
  misc_feature (237)..(237): n is a, c, g, or t
  modified_base (350)..(350): a, c, t, g, unknown or other
  misc_feature (350)..(350): n is a, c, g, or t
  modified_base (501)..(501): a, c, t, g, unknown or other
  misc_feature (501)..(501): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttntgcttattggtaccagcagaagccaggccaggcccctgtgttggtgatatataaggacactgagaggccctcagggatccctgagcgattctctggcctcacctcacgggacnctagtcacgttgaccatcagtggagtccaggcagaggacgaggctgactaccactgtacaaatcaacagaacagcagttggttacttatgtacttcgactaacgtgggaccaaggtccaccgtcctacggtcacgccaacggcccaacccntacgtcacttccg

SEQ ID NO: 358173 - DNA, 585 bp, Homo sapiens
  misc_feature: GZ8MTXP02JCASB.52.82.H05.1.454.CMB.2.raw
  modified_base (300)..(300): a, c, t, g, unknown or other
  misc_feature (300)..(300): n is a, c, g, or t
  modified_base (398)..(398): a, c, t, g, unknown or other
  misc_feature (398)..(398): n is a, c, g, or t
  modified_base (427)..(427): a, c, t, g, unknown or other
  misc_feature (427)..(427): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtacaactggtggagtcgtgggggagcgtggtccagcctgggagtccctgagactctcctgtgcagcctctggattccaccttcagtacctatagtatacacgtgggtccncaggctccgtggacaagggctgggagtggggtgcatctatatacaaatgataggaaacaataaccattctacagacctaccgaaagggcctatccacntccacagacgacaatccaagaacacggtntactactaacaaatcgaaactagtttacgagtacgttaggacggacgacggtactagttaatacgtttacgtggtacggccggtaacgggtaaggggtaactttacggtaatttaagaacgacgtaacggtacccctaacggaacgtaccctattacg

SEQ ID NO: 358174 - DNA, 613 bp, Homo sapiens
  misc_feature: GZ8MTXP02FFYZO.52.82.H05.1.454.CMB.2.raw
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtacaaaccgttatgcttattggtaccagcagaacgccaaggccacggcccctgtgttggtgatataataaggacactgagacggcccctagaggggactcccgtgagcgtattctccgtggcctccacctcgagggacactagtctacgttgaccatcagtgagtccaggcagaggacgaggctacggactaaccacgtagtaccaaataccaaaacgaacgaaccgagacccgtaaggtttcggtttactttaagtcgttccgtttacgaacccgtaaaacggttcggggaaacccctaaaggggtccctaacccggttccgtaacgggtccaacgaaccccgaaaaggacccccaaaacccccgacttacggaccacgtttcccg

SEQ ID NO: 358175 - DNA, 582 bp, Homo sapiens
  misc_feature: GZ8MTXP02I2JNN.52.82.H05.1.454.CMB.2.raw
  modified_base (264)..(264): a, c, t, g, unknown or other
  misc_feature (264)..(264): n is a, c, g, or t
  modified_base (306)..(306): a, c, t, g, unknown or other
  misc_feature (306)..(306): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtacaactggtggagtcgtgggggagcgtggtccagccgtggggacgtccctgagactctcctgtgcagcctntggacttcacttcagtacctatagtatacacgtcgggtcccncaggcctccgtggacgaagggctgggagtgggtgcatctatatacaaatgataggaaaacataaccattcaacagtactaccgtaaagggcctaattccacctatacctaccgagaacgaactaaacttaacccaaaacgtcggtactactactaaacaaatagaacttagttagagtacgttagaggactacggtactagtaatacgtacgtgtacgacgacggtaaggtacttacgtaattacgtagctacggacctacgaacacctactatac

SEQ ID NO: 358176 - DNA, 559 bp, Homo sapiens
  misc_feature: GZ8MTXP02HV434.52.82.H05.1.454.CMB.2.raw
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
  modified_base (339)..(339): a, c, t, g, unknown or other
  misc_feature (339)..(339): n is a, c, g, or t
  modified_base (389)..(389): a, c, t, g, unknown or other
  misc_feature (389)..(389): n is a, c, g, or t
  modified_base (410)..(410): a, c, t, g, unknown or other
  misc_feature (410)..(410): n is a, c, g, or t
  modified_base (542)..(559): a, c, t, g, unknown or other
  misc_feature (542)..(559): n is a, c, g, or t
tcagcgcagtacgacacgaccggtgctcgatttagtcgagctctctcgcgggcacgaccggtgctcgatttagatcgtctgtgttgggtttgggtccggcagccccccgggaagggcctggagtggattggagatatctactacagcgggggcaccagctacagtccctccctcaagagtcgagttggcatatcaatagacacgtccaagaatcagttctccctgaagctgaaatctatcattgtgcggacatggcctntattattgngcgagacatggcagcccatatagtcncgtggtccgaccccgtggggcccggtaatccccggtcaccgtccnccccagccttaccaccgaacggccccatcggtcccttcccccgtcggccncccctgccctccgacggtacnccaccgttcgtcgggggccacgacggcccggcccgtggggctcgtccgtcggtccgaaaggtaccttacttcccgttaaatacgtacgtccgtctaggacggccgggctgggaccgaagggcgactaagcgnnnnnnnnnnnnnnnnnn

SEQ ID NO: 358177 - DNA, 703 bp, Homo sapiens
  misc_feature: GZ8MTXP02HAHMR.52.82.H05.1.454.CMB.2.raw
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatattctgtaccaaaccgttatcgtacctttagttcggtaacccagcaaggaagcccaaggccacgggcccccttaggtcggtttggtacgaattataagtaaggacccacgtagagacggccctagaggggctcccgtaggacgctagttctcgtcgggtacctccgacccgtacgacgggtaacctacgttacgtaccgtacgtttacggaacctacgtaccgtaagggttcgggaaacgttcccggaagggccgaaacggggaacgggaaaccggaacggggtccttaacgggaaccccttaacccgtaacgttacgggttaaccaaaacggtaaccaaacccgaagggtaaccaagggtactaaacgggtttcggtttacttaacgttcgttaccgtttaccgggaacttaacccggttacggggaaaccttaaacccgggg

SEQ ID NO: 358178 - DNA, 697 bp, Homo sapiens
  misc_feature: GZ8MTXP02HCOC4.52.82.H05.1.454.CMB.2.raw
  modified_base (241)..(241): a, c, t, g, unknown or other
  misc_feature (241)..(241): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagtatattctgtactaaaccgtttntgtacttagtacgtacagcagacgcgacggccgacggtcccgtggtgttggtagtataagtaagtaacggactacgtaggacggacggtacccgtacggacgggtactccgtaggacgtcgtacgttcgtccgtcgtcctaccgaccgtcgacggacctacgtacgtaccgtacgttacgaccgtacgtacgtaggtacggtacgtacccggaggacgaacggacggaacggacggtacgtaacgtaaccgtaaccgtacgtacgtaacctaaacgtaaccgtaaacgaacgaacgtacgtacgttacggttacgttacgttacgttacgttaccgttacgaaccgtaaacggtacgggtaaccgtaacggtaccgtacccggtaccgtacggtacccgaaccggaacccgtaaccgaacccctaacccgtaccgtaccgtaccgtaccgttcccg

SEQ ID NO: 358179 - DNA, 564 bp, Homo sapiens
  misc_feature: GZ8MTXP02HJJRB.52.82.H05.1.454.CMB.2.raw
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgtcttattggtaccagcaagagccaggccaggcccctgtcgttgatgatatataacggacactgagacgccctgaggggactcccgtgagcgtattctcgtggcctcccacctcgagggaaccacgttacgctacggttcacctatcgagtggactccgagcagaggacgtagctgactaccactcgtacaactcaaacgacgtaacgacgaccgtaaggtttacggttaacctttaagttacggttccctttacgggacctaaacggtttacgggggtaaaaccccg

SEQ ID NO: 358180 - DNA, 526 bp, Homo sapiens
  misc_feature: GZ8MTXP02FF62P.52.82.H05.1.454.CMB.2.raw
  modified_base (217)..(217): a, c, t, g, unknown or other
  misc_feature (217)..(217): n is a, c, g, or t
  modified_base (239)..(239): a, c, t, g, unknown or other
  misc_feature (239)..(239): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctgganatattctgtaccaaaccgttangtcttattggtaccagcagaagccaggccacggcccctgtgttggtgatatataaggacactgagaggccctcagggactcccgtgagcgtattctcctggcctccacctcgagggactctagtcacgttgaaccatcagtggatccgaggcagaggacgaggctgactaccactgtcaaatcaaacagacagcagtgttactatgtcttcgacaacgtggggacctaacggtccaccgtaccgtacggtcacgaaccccaaggccccaaacccacgtcgcactccg

SEQ ID NO: 358181 - DNA, 712 bp, Homo sapiens
  misc_feature: GZ8MTXP02G618Y.52.82.H05.1.454.CMB.2.raw
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctggagattattctgtacaaaccgtttatgtaccttattcggtaaccagacagaacgccaaggcccacggcccctgtgttggtagaatatataaggacatggagacggtccctacgagggtacctccgtagacgtcgtaactttctacccgtggccctaccgaaccgttcgaacgggacctaccgttagtaccgtacgggtttaccgaacctactacgtaacggtagggtacgttcccgaaggacggaagacggggtaacggacgggacttacggaacccttaaccgaccttaggaaccaaagtaccaaacgagacccgaagtaccgtaaggggttccgttttacgtattacgttccgttacgaacctaaacgggttacggggaaacccctaaaaggggtcccctaaaccggtttaccgtaaccggtaccgaaaccggaaccccctaaacgggacccccctaaaaccccgtaccgttaccgtacccgtacccgttccg

SEQ ID NO: 358182 - DNA, 570 bp, Homo sapiens
  misc_feature: GZ8MTXP02JWNXQ.52.82.H05.1.454.CMB.2.raw
  modified_base (257)..(257): a, c, t, g, unknown or other
  misc_feature (257)..(257): n is a, c, g, or t
  modified_base (296)..(296): a, c, t, g, unknown or other
  misc_feature (296)..(296): n is a, c, g, or t
  modified_base (329)..(329): a, c, t, g, unknown or other
  misc_feature (329)..(329): n is a, c, g, or t
  modified_base (360)..(360): a, c, t, g, unknown or other
  misc_feature (360)..(360): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtacaactggtggagtctgggggagcgtggtccagcctgggagtccctgagactctctgtgcagcctntggattcaccttcagtacctatagtatacacgtggtccncaggcctccgtggcaagggactggagtgggtgnatctatatacaaatgataggaaacataaccnttcacatacctacgaaagggccatcacatctccagagactaataccaagaacacgggtctactaactaacaaatacgaactagtttgaaagtaccgttaggacggtaacgacgggtattaggtaaacttaagttacgtggtagcggtacggtaaggggtacttacgtattaagtaacgcgaaccgtcccgtaacgaaaccgtacaactcc

SEQ ID NO: 358183 - DNA, 646 bp, Homo sapiens
  misc_feature: GZ8MTXP02GNTAQ.52.82.H05.1.454.CMB.2.raw
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtacaaaccgttatgtcttattggtaccagcagaagccaggccacggcccctggtgttggtgatatataaggacacgtgagacggccctgagggactcccgtgagcgtattctccgtggcctccacctcgaacggggacacgtagtctacgttacgacctatccgaggtggacgttacccgagggacaggacgggaacggacggtctacggaacctaacccgacttaggtaccaaattaccaaacgacgaacgacgaccgtaaggttcggtttacttaagtcgttctttacggactaaacggttcgggaaacccgtaaacgggttcccgaacccggttaccgtaacggggttacccaaccggaaccccgtaaaccgggacccctaaacccccgaacttccggtacctacccgtttaccccg

SEQ ID NO: 358184 - DNA, 611 bp, Homo sapiens
  misc_feature: GZ8MTXP02I0MNJ.52.82.H05.1.454.CMB.2.raw
  modified_base (175)..(175): a, c, t, g, unknown or other
  misc_feature (175)..(175): n is a, c, g, or t
  modified_base (304)..(304): a, c, t, g, unknown or other
  misc_feature (304)..(304): n is a, c, g, or t
  modified_base (377)..(377): a, c, t, g, unknown or other
  misc_feature (377)..(377): n is a, c, g, or t
  modified_base (452)..(452): a, c, t, g, unknown or other
  misc_feature (452)..(452): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagcttgggttttcctcgttgctcttttaagnggtgtccagtgtcaggtacaactggtggagtcgtgggggagcgtggtccagccgtgggacgtccctgagactctcctgtgcagcctctggattcaccttcagttacctatagtatacacgtgggtcccncaggcctccgtggcaagggctgggagtgggtgcatctatatacaaatgaataggaaaacataacccattcaanacgtactaccgtaaagggcctattccacctatcctacaagacaactaaacttcccgaaagtaaccgtacgggttntaccttaactaaactaaaagtcgtaaactagtttagaacgtacgttggaacggtacacgggtctagtaattacttacgtgtaggccggaggtaaggggttacttacggaatttaagaacggacctacggtacccgtaaggaaacctaccgtattaaccg

SEQ ID NO: 358185 - DNA, 587 bp, Homo sapiens
  misc_feature: GZ8MTXP02IXNXX.52.82.H05.1.454.CMB.2.raw
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacaggacggccaggatcacctgctctggagattattctgtacaaaccgttatgcttattggtacagcagancagcngcctgtgtgnatatanaaggacactgagnggccctgagggactccgngagcgtattctctgcctccacctcgacgggacngtagtccacgttacgacctaagtcaagtggacgtaccaggcaaggagaacgtggctacgaactaccatgtaaccaaataccaaaagacgaacgagacgttagttacgtttacttagtcgttacgttacgaacggtaacgtaccgggtaaaccgtaacggtacctaccggtaccgtacggtacccgaaaccgaaccccgaaacccggacccctaaacccctcgtaccgtacctaccgtttccg

SEQ ID NO: 358186 - DNA, 659 bp, Homo sapiens
  misc_feature: GZ8MTXP02I5MYV.52.82.H05.1.454.CMB.2.raw
  modified_base (280)..(280): a, c, t, g, unknown or other
  misc_feature (280)..(280): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctggtgtcagtgtcccccaggacagacggccaggatcacctgctctggagattattctgtacaaaccgttatgcttatggtacagcagagccaggccacgccctgtgttggngatatataaggacactgagacggccctgagggactcccgtgagcgtattctccgtcgcctccacctcgacgggaccacgtacgtctacgttcgacctatcgaggtggacgtaccgaggcgaaggagggaacgacggctacgaacctaccactacgtactaaactacgaaacacgacgaacgaccgtaggttcggttactttagtcgtttccgttaccgtaaccgttaaaccggttacggggtaaacccgtaaccgggtacccgtaaaccccgggtttacccgttaacggtaccccgaacccgtaacccccgggaaaacccggtaccccccgtaaaaccccccgtaaccgttacccggtaaccctaacccgttttccccg

SEQ ID NO: 358187 - DNA, 760 bp, Homo sapiens
  misc_feature: GZ8MTXP02JPHV2.52.82.H05.1.454.CMB.2.raw
  modified_base (218)..(218): a, c, t, g, unknown or other
  misc_feature (218)..(218): n is a, c, g, or t
  modified_base (241)..(241): a, c, t, g, unknown or other
  misc_feature (241)..(241): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganattattctgtacaaaaccgtttntgtcttagttcggtacagcaagacgccgacggccacggtccccttggttggttggtagtaattaagtaagtaaacggacctacgtaggaaggaccggtccccgtacggtacggggtaccttcccgtaggacgtcgtactttccgtcccgtcggtccctaccccgacccgtacggaacgggacctacgttacgtaccgtacgttacgaacctagtcgaaggtacgggacgtaccggaggacgaagggaacgggaacggacggtaccgtacgacctaacccgtacgttacgtaacctaaactaccgaaacgaacggaaccgtaacgtaccgttaagggtttacggtttaactttaacgtttcgtttaccgttaccggtaacccgtaaaaccgggtacggggaaacccgtaaacgggttaccccgtaaacccggttaccgtaaccggggtacccaaaccggaacccccggaaaaccggtaccccctaaaaccccgtacgttaccgtacccgtaacctttccg

SEQ ID NO: 358188 - DNA, 742 bp, Homo sapiens
  misc_feature: GZ8MTXP02IK45R.52.82.H05.1.454.CMB.2.raw
  modified_base (221)..(221): a, c, t, g, unknown or other
  misc_feature (221)..(221): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtgganattattctgtactaaaccgttatgtcttagttcggtaccagacagacgccaggccacggcccctgtgttggtgatatagtaaggacacgtgacggaggcccctacggagggtactccgtggacgtcgtacttctccgtcgcctcccgacctcgacggacctacgtaacgtcgtaccgttacgaaccctagtaccgaggtacgggtacgtacccgacggacgaaggggaacgggaccggggacgggtaccgttacggaaaccccgttaacccgtaccggtttacggtaaacctaaacttaaccgaaaccgaaccggaacgaacgtacgtaacgggtttcggttttaaccgtttagttccgttaccgttaccgtaacgttaaaccgggtaccggggttaaaccgtaacccgggttaccctaacccggttaccgtaaccgggttaaccgaccccggtaaccccgaaccgggaaccccccctaaacccggtaccttacccggtaaccgttaccctttacccccgg

SEQ ID NO: 358189 - DNA, 694 bp, Homo sapiens
  misc_feature: GZ8MTXP02HGOSF.52.82.H05.1.454.CMB.2.raw
  modified_base (264)..(264): a, c, t, g, unknown or other
  misc_feature (264)..(264): n is a, c, g, or t
  modified_base (386)..(386): a, c, t, g, unknown or other
  misc_feature (386)..(386): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtacaactggtggagtcgtgggggagcgtggtccagccgtggggacgtccctgagactctcctgtgcagcctntggattccaccttcagtacctatagtatacacgtggtcccgcaggcctccgtggaccaaggggctgggaggtggggtgactatctatatacaaaatgaataacggaaaactaataaaccctntttaccaaacaacgtaacccgttaacccggtaaaacggggccctaaattacccaaccctattcccaccgaagaacgtaacctaaacttaccccgaaaagaaccctaacgggttctacctaaactaaacctaaatacgaaaaccgttaggtttagaagtaaccgtttaggaacgggaactaccgggtattaggttaaataacgtttaccgtggttacggacgtacgggtaacggggttaaatttaccggtaatttaaggaacgtaccgtaaaccggccccgttaaaagaaaccggaccctaattaaccg

SEQ ID NO: 358190 - DNA, 624 bp, Homo sapiens
  misc_feature: GZ8MTXP02I1SHR.52.82.H05.1.454.CMB.2.raw
  modified_base (211)..(211): a, c, t, g, unknown or other
  misc_feature (211)..(211): n is a, c, g, or t
  modified_base (253)..(253): a, c, t, g, unknown or other
  misc_feature (253)..(253): n is a, c, g, or t
  modified_base (341)..(341): a, c, t, g, unknown or other
  misc_feature (341)..(341): n is a, c, g, or t
  modified_base (470)..(470): a, c, t, g, unknown or other
  misc_feature (470)..(470): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctcccctcctcactctctgcacaggctctgagcctctatgagctgacacacgcccacctcggtntcagtcgtccccaggacagacggccaggactcacctgctcgnggaagatattctgtactaaaccgttatcgtcttagttcggtaccagcgaacgtacgaccgaggccgacggtcccctggtcgttggtanattaataacgtaagaccacgtgacgtaccggtccctacggacgggtcctccgtaggacgtacgtacttcgtcgtcggtcctcccgtaccgtacgacgggtactaacgtacgtccgtacgttacgaaccngtacgtaggtacgtacgtaccgaggtacgaggaacggacggagtacgtcgaaaccgtcacgttacgtaacaacgtacgaaacgtacgaaactacgtacgtaacgttgttacttaacgtcgttacgtacgacgtaacggtccggtaaactaacgg

SEQ ID NO: 358191 - DNA, 564 bp, Homo sapiens
  misc_feature: GZ8MTXP02I21VL.52.82.H05.1.454.CMB.2.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (353)..(353): a, c, t, g, unknown or other
  misc_feature (353)..(353): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatattctgtcaaaccgttntgcttatgtacancagagcagcaggccctgtgtggtgatatataaggacacgtgagacggtcctgaagggactcccgtgacgcgattctccgtacggcctccacctcgacgggacncgtacgtcaacgttcgaccattcgagtcgagtaccgagcaggacgtacgacggctagacctacgatagtactaactcaaacacgacaaagtctaggttacggttccttaagtcgtacttcgactaacggtgggaaaccagttccaaccggttccgtaaggccaacgaacccgaacggacccctaaccccgacgtcctacgaacctttcccg

SEQ ID NO: 358192 - DNA, 559 bp, Homo sapiens
  misc_feature: GZ8MTXP02FWC93.52.82.H05.1.454.CMB.2.raw
  modified_base (238)..(238): a, c, t, g, unknown or other
  misc_feature (238)..(238): n is a, c, g, or t
  modified_base (461)..(461): a, c, t, g, unknown or other
  misc_feature (461)..(461): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacgacagccaccctcggtgtcagtgtccccaggacagacggccaggatcacctgctctggagatattctgtcaaaccgttngcttattggtaccagcagaagccaggccacggcccctgtgttggtgatatataaggacactgagaggccctcgagggctcccgtgagcgattctcgtcggcctcccacctcgacggggacacgtagtcacggttacacctatcgagtgggatccgaggacaggaggacgagggctgaacctaccactgtacaataccaacgagacagactagtggttcttagngttctcgacgtaacgtcgggaaaccacggtccgaccgtccgtaacggtccaacggaaccccgaaacggaccccaaacccccacgtcgtccactttccc

SEQ ID NO: 358193 - DNA, 515 bp, Homo sapiens
  misc_feature: GZ8MTXP02HC1PY.52.82.H05.1.454.CMB.2.raw
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (466)..(466): a, c, t, g, unknown or other
  misc_feature (466)..(466): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttatggtaccagcagagccaggccaggcccctgtgttggtgatatataaggaccactgagacggccctgagggntcccgtgacgcgattcnctggcctccacctcgagggacacgtagtcacgttcgaccatcgagtgagtccgaggcaaggacgacgaggctagactaccactgacaagtcaaacgngaccagcagtcggttactaagtcgtcttcgactacgtcggacctaacgg

SEQ ID NO: 358194 - DNA, 720 bp, Homo sapiens
  misc_feature: GZ8MTXP02GSJ8P.52.82.H05.1.454.CMB.2.raw
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (307)..(307): a, c, t, g, unknown or other
  misc_feature (307)..(307): n is a, c, g, or t
  modified_base (352)..(352): a, c, t, g, unknown or other
  misc_feature (352)..(352): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagctgagttttcctcgttgcttcttttaagaggtgtccagtgtcaggtacaactggtggagtcgtgggggagcgtggtccagccgtggggacggtccctgacgactctcctgtgcagcctnggattcaccttnagtacctatagtactacacgtcgggtcccnccgaggtcctccgtgggaccaaggggtacctggggaggttggggnggactagttctaagtactaccaaagtgaactaaggaaaaccaattaaccctattcctaaacacgtaaccgtacccgggtaaaaggcccgtaattacccaacccgtacttaccctacccgaaaggtaaccgtaaacctaaaccgttacccgaaaacggtaaacccgtaccgggttacgtacccttaacttaaaacccgtaaaagttaccggtaaaacgttacggtttagaaacgtaaccgtttaggaacgggaacctacggggtacctttagttaacttaacgtttaacgtggttacggacgacgggtaaagggtaacttgtaaacgttaagtacgaccgacggtaccctaacggaaccgtacctaacg

SEQ ID NO: 358195 - DNA, 534 bp, Homo sapiens
  misc_feature: GZ8MTXP02FUNXM.52.82.H05.1.454.CMB.2.raw
  modified_base (302)..(302): a, c, t, g, unknown or other
  misc_feature (302)..(302): n is a, c, g, or t
  modified_base (332)..(332): a, c, t, g, unknown or other
  misc_feature (332)..(332): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (488)..(488): a, c, t, g, unknown or other
  misc_feature (488)..(488): n is a, c, g, or t
  modified_base (512)..(512): a, c, t, g, unknown or other
  misc_feature (512)..(512): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtacaactggtggagtcgtgggggaggcgtggtccagccgtgggaggtccctgagactctcctgtgcagcctctggattcaccttcagtacctatagtatacacgtgggtccnccaggctccgtggcaaggctgggagtgggngcatctatatacaaatgaatagaaaacaataaccattcacagtactaccgtaaagggccattccacatcctcagacacaactaccaanaacncggtatctactaacaaatgaaactagttagatacgttagaggacgaggtctagtaatattacgngtgcgaggaaggtattcgattagngcacgccctaggaacaccatac

SEQ ID NO: 358196 - DNA, 635 bp, Homo sapiens
  misc_feature: GZ8MTXP02HEZ3H.52.82.H05.1.454.CMB.2.raw
  modified_base (263)..(263): a, c, t, g, unknown or other
  misc_feature (263)..(263): n is a, c, g, or t
  modified_base (303)..(303): a, c, t, g, unknown or other
  misc_feature (303)..(303): n is a, c, g, or t
  modified_base (558)..(558): a, c, t, g, unknown or other
  misc_feature (558)..(558): n is a, c, g, or t
  modified_base (574)..(574): a, c, t, g, unknown or other
  misc_feature (574)..(574): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtacaactggtggagtcgtgggggagcgtggtccagccgtgggacgtccctgagactctcctgtgcagcctntggattcaccttcagtacctatatatacacgtgggtcccncaggcctccgtggacaagggctgggaggtgggtgcatctatatacaaatgaataggaaaactaataacctattactaacagtaaccgtaccggtaaaaggggccctattacccaacctatcctacccgaaaggaactaaaccctaaacttaaccccgaaaaggtaaacccgtaacggggttcttaaccctaaacttaaaacaaaagttacgtaaacgtaggttttagaaacgtacgttaggaacggtacacggtntaagtaatacttacgngtacggcgaggtaaaggtacttacgattagaacggcaccgtccctaaggaactacctatac

SEQ ID NO: 358197 - DNA, 662 bp, Homo sapiens
  misc_feature: GZ8MTXP02IVMAI.52.82.H05.1.454.CMB.2.raw
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganattattctgtactaaaccgttntgcttattggtaccagcagagccgagccacggccctgtgttggnatatanaaggacactgagaggccctgagggactcccgtgacgtcgtatttcctccgtcggcctaccctaccgtacgacggggaccacgttacgtacgtaccgtttacgaccctagtacgtaggtggacgtaccgaggacaggaagggacggacgggtctacggaccttaaccgacttaggtaactaaactaccaaagacgaacgaacgacgttaacggttcgttttacgttaagtttcgttacctttccgaaccgttaacggtacgggaaaacccgtacggtacccgtaacccggttaccgtaacggtacctaaacccggaacccgaaaccggaccccctaaaccccgacgttaccgtaccttaacccgttccccg

SEQ ID NO: 358198 - DNA, 650 bp, Homo sapiens
  misc_feature: GZ8MTXP02GQC3W.52.82.H05.1.454.CMB.2.raw
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (291)..(291): a, c, t, g, unknown or other
  misc_feature (291)..(291): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtgganattattctgtactaaaccgttntgtcttagttcggtaccagcagaacgccaggccaggcccctgtgttggngatatataaggacactgagacggccctagaggggactcccgtaggacgtcgtatttccgtccgtcgggccttcccacccgttcggaacgggacctaccgttaggtaccacggtttacgaccctataccgagtcggacgtacccgaggacgaaggacgggacgacggtactacggaacctaccacgtacgtacaaactaccgaaacgagaacgacgacgtagtttcggttacttagttgttccttacggacctaacgggtacggaaccgtaacggttaccgacccgttccgtaacggtaccaaccggaaccccgaaacggaccccctaaacccgtacgtccgtaacctaccgtttccccg

SEQ ID NO: 358199 - DNA, 579 bp, Homo sapiens
  misc_feature: GZ8MTXP02IKLAO.52.82.H05.1.454.CMB.2.raw
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (261)..(261): a, c, t, g, unknown or other
  misc_feature (261)..(261): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagcccaccctcggtgtcagtgtccccaggacaggacggccaggatcacctgctctgganatattctgtacaaaccgttntgcttattgtaccagcagaancagccaggccctgtgtgnatatanaagcatgagngcctgagggactcccgtgagcgattctccgtgcctcccactcgagggaccactacgtctaacggttcgacccagttcaagtgggtacgtacccgaggcgaaggacggacggacggacgttcggaaccttaccacgttaggtacctaaatacgaaacaagaccaggtctagtcggttacttagtcgttcttcgactaacgtcgggaacccaggggtacccacggttaccgaacggtccaacgaacccgaaccggaccaaacccccgtatacgtaccacgttcccg

SEQ ID NO: 358200 - DNA, 634 bp, Homo sapiens
  misc_feature: GZ8MTXP02JQSRW.52.82.H05.1.454.CMB.2.raw
  modified_base (471)..(471): a, c, t, g, unknown or other
  misc_feature (471)..(471): n is a, c, g, or t
  modified_base (610)..(610): a, c, t, g, unknown or other
  misc_feature (610)..(610): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagattattctgtaccaaaccgttatgctttattcggtaccagcagaacgcaggcacggcccctgtcgttgtgatagtataaggacacgtgaaggacggccctagagggactcccgtgagcgtattctccgtcggccttccaacctcgaacgggactacgtacgtactacggttacgacctagtaccaggttcggagtacccgaggcaaggacggacgaacggcttaggacctaccgactacgtacaaatccaaanacggaacagtacctaggttacggtttacttaagttcgtacctttacggacctaaacgtgggtaaacccaaacggttcccgaaccgttccgtaacgggttacccacgtaaccccgaaacggtacccctaaaacccccggnttaccggtacctactttaaccccg

SEQ ID NO: 358201 - DNA, 714 bp, Homo sapiens
  misc_feature: GZ8MTXP02GNAY9.52.82.H05.1.454.CMB.2.raw
  modified_base (220)..(220): a, c, t, g, unknown or other
  misc_feature (220)..(220): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatattctgtactaaaccgttatgtcttattggtaccagcagaacgccgaggccacggcccctgtgttggtgatatagaaggacagtgagacggccctagaggggtactccccgtaggacgcgtacttctccgtcggcctcccaccgttcgaacgggactacgtacgtaccgtacgtttacgaccctagtaccgtaagggtacgggtacgttacccggaagggtccgaaaggggaacggggaacggacggggtaccgttaacggaaacccgttacccgaacgttacggtaacctaaaacgttacccgaaaacgacggtaaaccgaagtacccggttaaggtttacgggtttactttaacgttcggtttaccgttaccgaacgtaacggtaccggggaaaccctaaacgggtaccctaccggttacccgtaacggtaccgaaaccggaacccgaaaccggacccctaaaccccgactccgtacctaccgtttcccg

SEQ ID NO: 358202 - DNA, 528 bp, Homo sapiens
  misc_feature: GZ8MTXP02J2W18.52.82.H05.1.454.CMB.2.raw
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
  modified_base (406)..(406): a, c, t, g, unknown or other
  misc_feature (406)..(406): n is a, c, g, or t
  modified_base (508)..(512): a, c, t, g, unknown or other
  misc_feature (508)..(512): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (518)..(528): a, c, t, g, unknown or other
  misc_feature (518)..(528): n is a, c, g, or t
tcagcgcagtacgacacgaccggtgctcgatttagtcgagctctctcgcgggcacgaccggtgctcgatttagatcgtctgtgttgggtttgggtccggcagcccccccgggaagggcctggagtggattggagatatctactacagcggggcaccagctacagtcccctccctcaagagtcgagttggcatatcaatagacacgtccaagaatcagttcctccctgaagctgaaatctatcattgtgcggacacggcctntattatgngcgagacatggcagccccatatagtcgcttggttccaccccgtggggcccggaactcccggtccaccgtctccccagcctccacaacggcccccagtcgtccttcccccgngccnccngcncgagcncctcgtcggnggcacgcgccgccgtcggcgtcgccgtacggacgaacgtacctacgttcctacgtacgacgtcgtcgtcggacggcggcgtcggacgacggcgtacagagcnnnnncncncnnnnnnnnnnn

SEQ ID NO: 358203 - DNA, 673 bp, Homo sapiens
  misc_feature: GZ8MTXP02IEBW4.52.82.H05.1.454.CMB.2.raw
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
  modified_base (310)..(310): a, c, t, g, unknown or other
  misc_feature (310)..(310): n is a, c, g, or t
  modified_base (630)..(630): a, c, t, g, unknown or other
  misc_feature (630)..(630): n is a, c, g, or t
  modified_base (644)..(644): a, c, t, g, unknown or other
  misc_feature (644)..(644): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtacaactggtggagtcgtgggggagtcgtggtccagccgtgggacgtccctgagactctcctgtgcagcctntggtattcaccttnacgtacctatagtactacgacgtcgggtcccncaggtcctccgtggaccgaaaaggggtctggggaggttggggtcgacgtataccttaagtactactaaagtgaagtacggaaaaactaaattaaacccattttccaacgtaagtaacccgttaccgggtaaaaggggcccttaaattcccaaccctatcccgtacaaggaacctaactaaacgtttacccgaaaagtaaccgtacgggttactacccttacgtaaacctaaaagtacggtaaacgtaggtttagaaacgttacgttaaggacgtaccgtacggttactagtattacttacgtgtcgacgtaggaaaggtntaccgtattaacgngaccgacgtaccagaacgacctagtaacc

SEQ ID NO: 358204 - DNA, 630 bp, Homo sapiens
  misc_feature: GZ8MTXP02JSMB9.52.82.H05.1.454.CMB.2.raw
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctggagatattctgtacaaaccgttatgtcttattggtaccagcagaagccaggccacggccctggtgttggtagatatagtaaaggacagtgagtacggcccctagacgggtactccgtgacgtccgtatttccgtccgtggcctcccaccttcgaagggaccacgttagtcctacggttacacctagttcgaaggtcggacgtccgaggcaggacggacgaggctacggacctaaccgtacgtacgtacaaactacaaacgacgaccgagtaccgtaaggttcggtttaccttagtcgttacgttcgacgttaacgtacgggtaccaaacggttcccgacccgttaccgtacggttacccaaccgtaaccccgaaacggtacccccaaaacccgtctacggtacccacgtttccccg

SEQ ID NO: 358205 - DNA, 684 bp, Homo sapiens
  misc_feature: GZ8MTXP02H8IZB.52.82.H05.1.454.CMB.2.raw
  modified_base (245)..(245): a, c, t, g, unknown or other
  misc_feature (245)..(245): n is a, c, g, or t
tcagcgcagtacgacacgaccggtgctcgatttagtcgagctctctcgcgggggtgggtccaggaggcagaactctgggcgtctcaccatggcctggatccctctacttctccccctcctcactctctgcacaggctctgaggcctcctatgagctgacacagcccaccctcggtgtcagtctccccaggacaggacgccaggatccacctgctcgtgggatatattctagtctaaaaccggttntgtcttagtacgtacagcagacgccgacggccgacggtccctgttgtgtagtatagtaagtaacgactacgagacggcgtaccgtagacgggtactccgtagacgtacgtacttcgtccgtcgtcctaccgaccgtacgacggtactacgtacgtactaccgttacaaccgtacgtacgtaggtacggtacgaccggaagggacgaacggggaacggtaaccggacggtaccgtaaccgtaacccttacgtacgtacgtaacctaaacgtaaccgaacgacgaacgtacggtacgttacggtttacgtttacttgttaccgttacgtaccggaaccgtaacggtacggtaaccgaccgtaccgtaccgttaccgtacgtacccgaaccgaacccgtaaaccgacccctaaacccgtcgtaccgtaacctaccgttcccg

SEQ ID NO: 358206 - DNA, 628 bp, Homo sapiens
  misc_feature: GZ8MTXP02JWRX3.52.82.H05.1.454.CMB.2.raw
  modified_base (262)..(262): a, c, t, g, unknown or other
  misc_feature (262)..(262): n is a, c, g, or t
  modified_base (304)..(304): a, c, t, g, unknown or other
  misc_feature (304)..(304): n is a, c, g, or t
  modified_base (346)..(346): a, c, t, g, unknown or other
  misc_feature (346)..(346): n is a, c, g, or t
  modified_base (546)..(546): a, c, t, g, unknown or other
  misc_feature (546)..(546): n is a, c, g, or t
tcagcgcagtacgacacgaccggtgctcgatttagtcgagctctctcgcggggtctgggagacgagcccagcactggaagtcgccggtgttcccattcggtgatcatcactgaacacagaggactcaccatggagtttgggctgagctgggttttcctcgttgctcttttaagaggtgtccagtgtcaggtacaactggtggagtcgtgggggagcgtggtccagccgtgggaggtccctggagactctcctgtgcagcctntggattcaccttcagtacctatagtatacacgtgggtacccnccaggctccgtggacaagggctgggagtggggtgcatctatntacaaaagtgaagtaggaaaacaataacccatttccaacagtacctaccggtaaaaggggccctaattcccactactacctacccaaggacaacctaaacttacccgaaaacgaaaccgtacgggtacgtacctacctaaaccgtaaaattacggaaacctaggtttacggaagtaccgttaggaacggacgaaccggtntagtattacgttacgtgtacgcgtaggtaacggtacttcgtaattagaacgacgtaccgtacccgtacgaaccgactactcg

SEQ ID NO: 358207 - DNA, 731 bp, Homo sapiens
  misc_feature: GZ8MTXP02HINR9.52.82.H05.1.454.CMB.2.raw
  modified_base (246)..(246): a, c, t, g, unknown or other
  misc_feature (246)..(246): n is a, c, g, or t
  modified_base (295)..(295): a, c, t, g, unknown or other
  misc_feature (295)..(295): n is a, c, g, or t
  modified_base (361)..(361): a, c, t, g, unknown or other
  misc_feature (361)..(361): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagcccaccctcggtgtcaggtcgtccccaggacaggacggccaggatccacctgctcgtggagtatattctgtactaaaccgttntgtacttagttcggtacagcagaagccaggccacggcccctgtgttggntatagtaagtaaggactacgtgagacggtccctaggacgggtacctccgtggacgtcgtactttcncccgtcggcctcccaccgttacggacgggtacaccgttacgtaccgtacggttcgaaccctagttaccgagggtcggtacgtacccgagggacgaagggaacgggaccggagtaccgtacggaacctaccgacgttacggaacctaaactaccgaaaacgacggtaaccgaacggtcgtaacgggtttacggtttactttaacggttccggttaccgtttaccggaaccggttaaaccgggtaacggggtaaccccgttaaaccgggtacccgtacccggttacccggttacggtaccccgaaccggtaacccccggaaacggaccccctaaacccccgtacggtacctacccgttaacccgtttccccg

SEQ ID NO: 358208 - DNA, 652 bp, Homo sapiens
  misc_feature: GZ8MTXP02FK1P5.52.82.H05.1.454.CMB.2.raw
  modified_base (303)..(303): a, c, t, g, unknown or other
  misc_feature (303)..(303): n is a, c, g, or t
  modified_base (370)..(370): a, c, t, g, unknown or other
  misc_feature (370)..(370): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagcttgggttttcctcgttgctcttttaaagaggtgtccagtgtcaggtacaactggtgagtctgggggagcgtggtccagcctggggaggtcccctgagactctcctgtgcagcctctggattcaccttcagtacctatagtatacacgtgggtcccnccaggctccgtggcaagggactggagtgggtgcatctatatacaaatgaataggaaaacataacccntttccaacacgactaccggtaaaaggccgaattccaaccatcctacccaagaacgaaccaaactacccaaagaaaccacgggttatacctactaaacaaaatgaaacctaggtttagacgtacgttaggaacggtaaccgacgggacttaggttaacttaactttaccgtaggttcggaccggtacggtaaaggggtaaactttaccggtaattttaacgtaaccggtaccgaaccggtacccccgttaacggaaaaccggtaacccctaacgtttaacccg

SEQ ID NO: 358209 - DNA, 652 bp, Homo sapiens
  misc_feature: GZ8MTXP02HG9LJ.52.82.H05.1.454.CMB.2.raw
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
  modified_base (606)..(606): a, c, t, g, unknown or other
  misc_feature (606)..(606): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtacaactggtggagtcgtgggggagcgtggtccagcctggggagtccctgagactctcctgtgcagcctctggattcaccttnagtacctatagtataccacgtgggtccncaggctcccgtggcgaagggactgggagtggggtgactagtctaatagtacaaagtgataggaaaactactaaccatttaccacaacggtaacctaccggtaaaaggggcctaattaccgaaccctattccctaaccgagaacaactaaacttaccgaaaagtaaccgacggtagtacctactaaactaaatacgtaaactagtttagaacgtacgttaggaacggacgaccgtattagttaaacttagttaacgtcggtaggccggaacggttaaaggggaagtttaccgaagttttaaaccgnggaccgtaaccgtaccccgtaacggaaaccggacctaagttaaccc

SEQ ID NO: 358210 - DNA, 766 bp, Homo sapiens
  misc_feature: GZ8MTXP02IJBJ4.52.82.H05.1.454.CMB.2.raw
  modified_base (219)..(219): a, c, t, g, unknown or other
  misc_feature (219)..(219): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacaggacggccaggatcacctgctctgganatattctgtactaaaccgttatgtcttattggtaccagcaagagccaggccaggcccctgtgttggtgatatataaggacactagagacggcctacgaaggggtactcccgtaggacgtacgtaactttccgtccgtcgggacccttcccgaacccttacggaacggggtaaccctacgttacgttacctaaccggtttacgaaccctagttaccgagggttacggaacggttacccggaagggaccgaagggaacggggaacggacggggtcttacggtaaaccgtaaacccgacttacgggttaacctaaagtaccgaaaacgtacggaaacctaacggaccgtaaggtttacgggtttactttaaagttcgtttaccgtttacggacgttaaaaccgggtacggggtaaaaccctaaacgggttaccctaaaccggtttaccccgttaaacggggttacccaaccggtaaacccccggaaaacccgggtacccccaaaaacccccgtaacgttacccggtaacccttaaccgtttaacccccgg

SEQ ID NO: 358211 - DNA, 841 bp, Homo sapiens
  misc_feature: GZ8MTXP02HOKA5.52.82.H05.1.454.CMB.2.raw
  modified_base (223)..(223): a, c, t, g, unknown or other
  misc_feature (223)..(223): n is a, c, g, or t
  modified_base (261)..(261): a, c, t, g, unknown or other
  misc_feature (261)..(261): n is a, c, g, or t
tcagcgcagtacgacacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagagagagtgtgttgggttggggagcttggtccagcctggtgttcctgagactctcctgtgcagcctctggattcnccgtcaaggtagcaaactactatgagcgtcgggtcccnccgaggcctaccggaaggggaagggtctaggagtgggtcctacgtaaagttctttagcggtcggtacgaaccctaataagtttaattagtgacctaggtaccgttaccggtaggaaacggggtcctaacttacccaaacccgttacgtaccgtaccgaaaggaacggtaccgtaaccggtaacccgaaaacggtaaacccgtaccggtttaccgtttacgttttaaacctaaacgtaaaaggtcggtaaaccgttacggtaacgtaacggtaaacccgtacccggtaacggtaaacccggaaccgtaccgggttcttaacggttaacctttaaacgttacggtcggtaaaccggacgggtaaaccggaaaccggggaaacccgggggtcgggggaaccggaacgtaaccccggtaacccggttaaacccccggttaacggtacccgggggtaaccggggtacccgggaaaacccgggggtacccggtacccgtaccccgtcccgtaccgtacccgtaaccggtaccccgaaacccggtaaccgggaacccggtccctaaccggtttccccggtacccccg

SEQ ID NO: 358212 - DNA, 650 bp, Homo sapiens
  misc_feature: GZ8MTXP02JEJRC.52.82.H05.1.454.CMB.2.raw
  modified_base (214)..(214): a, c, t, g, unknown or other
  misc_feature (214)..(214): n is a, c, g, or t
  modified_base (257)..(257): a, c, t, g, unknown or other
  misc_feature (257)..(257): n is a, c, g, or t
tcagcgcagtacgacacgaccggtgctcgatttagtcgagctctctcgcgggcacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagcccaccctcggtntcagtcgtccccaggacagacgccaggatccactgctctgganatattctgtacctaaaaccgttatgtactttagttcggtaaccgagaccgaagaacgcccgtaacggcccgaacggtcccccgttggttggtttggtaggaattagtaaagtaaagggaccctacgtagaacgaacggtccccctagaagggtcctcccgtaggacggtaccgtatttcctcgtcggtccctcccgtaccctcgaacgggtacacgttacgtccacggttacactatccgaagttcggaagccgaagcgaaggaggacgaggctagacctacgactacgactaaactacaaacggactaccgaaagtccgtaaggtttccggttacgttaatacggttacctttacggaccgtaaacggtaccgggtaaccgttaaacccggg

SEQ ID NO: 358213 - DNA, 623 bp, Homo sapiens
  misc_feature: GZ8MTXP02FHCCF.52.82.H05.1.454.CMB.2.raw
  modified_base (272)..(272): a, c, t, g, unknown or other
  misc_feature (272)..(272): n is a, c, g, or t
  modified_base (328)..(328): a, c, t, g, unknown or other
  misc_feature (328)..(328): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagagcaggccaggccccngtgttggtgatatataaggacactgagacggcccctcgagggactcccgtagacgngactttcgtccccgttgggaccctccacccgtcgaggggaacctactaggtcctaacggtttcgaacccattcgaggttacgggagttcccgaagggggccaaggaagggacgaggctaggaccttaaccacgtgtaccaaatccaaacagaccagtccaaggttggttacttagtggtcctttcggacctaaacgttcgggaaacccaaacgggtccgaaacccgttccgtaacggtcaaccgaacccccgaaacggggacccccaacccccgacttaccgacctaccttcccg

SEQ ID NO: 358214 - DNA, 596 bp, Homo sapiens
  misc_feature: GZ8MTXP02FFTN2.52.82.H05.1.454.CMB.2.raw
  modified_base (158)..(158): a, c, t, g, unknown or other
  misc_feature (158)..(158): n is a, c, g, or t
  modified_base (174)..(174): a, c, t, g, unknown or other
  misc_feature (174)..(174): n is a, c, g, or t
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
  modified_base (332)..(332): a, c, t, g, unknown or other
  misc_feature (332)..(332): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagctgggttttccncgttgctcttttaagnggtgtccagtgtcaggtacaactggtgagtcgtgggggagcgtggtccagccgtgggagtccctgagctctcctgtgcagcctctggattccaccttnacgtacctatagtatacacgtgggtccnccgaggctccgtggcaagggctgggagtgggngcatcatatacaaagtcgatagaaaacaatacctattccagacgactccggtaaaaggccgaattccaaccatcctaccgaagacgaactactaccaaagaactacgggtactactactaaaccaaatacggaaactagtttacggacgtacgttaggacggaaccgtacggtctagtagttacttacgtcggtacgcggacggtaagggtactttacggaatttaagaacgactacgacccgtacgaaacgaccctataaccg

SEQ ID NO: 358215 - DNA, 740 bp, Homo sapiens
  misc_feature: GZ8MTXP02IYXTQ.52.82.H05.1.454.CMB.2.raw
  modified_base (158)..(158): a, c, t, g, unknown or other
  misc_feature (158)..(158): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
  modified_base (301)..(301): a, c, t, g, unknown or other
  misc_feature (301)..(301): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagctgggttttccncgttgcttcttttaagaggtgtccagtgtcaggtacaactgggtgagtcgtgggggagcgtggtccaggccgtggggacgtcctgagctctcngtncagcctcnggacttcacttcagtactatagtatacacgtcgggtccnccgaggcctccgtggacgaaacggggtcgtaggggaggtggggtggactagttactagtaactacaaaacgtgaaagtagaaaaaccaattaaaccctagtttaccgtaaagaaacgtaaccgttaaccgggtaaaacgggggacccgtaactttacccaaaccctacttacccgtaaccgaacgggtaaacgtaaacctaaaacgttaccccgaaaacggttaaaccccgtaacggggttacgttaaccttaaacccgtaaacctaaaagttaacggtaaaaccgttagggtttaacggaaacgtacggtttaagggaacggtacgaacggtacttaagtaattacgttaacgtcggtaggaccgtaggtaaggttaagtacgttaagttaacgtaacggacgaccgtaacccgtaggaaacctaccgtactaaccgg

SEQ ID NO: 358216 - DNA, 760 bp, Homo sapiens
  misc_feature: GZ8MTXP02GNI7N.52.82.H05.1.454.CMB.2.raw
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatattctgtaccaaaccgttatcgtcttattcggtaccagcagaacgccgaggccacggcccctgtcggttggtgatataataaggacacgtgagacggcctgagggactcccgtgacgtcgtactttctccctcggtcctacccgaacctcggaacggggaaccctaccgttacgtccgtaaaccggtttacgaacccgtacgtaccgtaacgggttacggggaaccgttaccggaacgggtaccgaaagggggaacggggaaccgggacgggtacgtaacggtaaaccgtaaccctacgtacggttaaccaaaacgttaccaaaacgacgaaacccgaaggtaccgttaaaggtttcgggtttactttaacgttcggttaccctttacggaaccgtaaaccggttacgggggaaaccctaaacggggttacccgtaacccggtttaccgtaacggggttacccaaaccggaacccccggtaaacccggaaccccgaaaaccccctacggttaccggtaccccgtaaccgtttcccccg

SEQ ID NO: 358217 - DNA, 672 bp, Homo sapiens
  misc_feature: GZ8MTXP02JUZ23.52.82.H05.1.454.CMB.2.raw
  modified_base (241)..(241): a, c, t, g, unknown or other
  misc_feature (241)..(241): n is a, c, g, or t
  modified_base (262)..(262): a, c, t, g, unknown or other
  misc_feature (262)..(262): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagattattctgtacaaaccgttntgcttattggtacagcaggancagccagccctgtgttggtgatatataaggacactgagacggccctagacgggactcccgtgagcgtacgtttctccgtggtcctaccctaccgtcggaacgggactacgtagtacgtaccgttacgaaccacgtcgaacgggtagtacggtacccgaggacgagggaacggacggacggctacggaaccttaacccgactacggtaaccaaactaccaaacgaacgaccgaaacgacgttaggttacggttacgttaacttcggttaccttacggtaaccgtaaaccggttacggggaaacccgtaaaacgggttcccgtaaaccccggtttccgtaacgggttaaccaaccgtaacccgaaccggtaaccccgaacccccgaactccggtacctacccgtttaccccg

SEQ ID NO: 358218 - DNA, 636 bp, Homo sapiens
  misc_feature: GZ8MTXP02JG1LC.52.82.H05.1.454.CMB.2.raw
  modified_base (397)..(397): a, c, t, g, unknown or other
  misc_feature (397)..(397): n is a, c, g, or t
  modified_base (434)..(434): a, c, t, g, unknown or other
  misc_feature (434)..(434): n is a, c, g, or t
  modified_base (519)..(519): a, c, t, g, unknown or other
  misc_feature (519)..(519): n is a, c, g, or t
tcagcgcagtacgacacgaccggtgctcgatttagtcgagctctctcgcggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtacaactggtggagtcgtgggggagcgtggtccagccgtggggacgtccctgacgtactctcctgtcgcacgtccctgtaggtacttaccgtaccttcgtaacgtaacctataacggtactaccgacggttcggggtaccccaccgaggtccgtaccgtggacaaaggggtctggggaggtaggggtcgactagtctagtaactanaaacgtgaagtacgaaaactactaacctatccgtaanaacgtaccgtaccgggtaaaggctactacaccatccccagaagacaactaacttacaaagacgtacgtagtactaacactaaagngtaacgtagttacgaacgtacgttaggacggtactaggtactagtacttaagtcttaggcgacgggagtaacggtattacggtattacgaacgcgacgtcctaagacgacctagtac

SEQ ID NO: 358219 - DNA, 530 bp, Homo sapiens
  misc_feature: GZ8MTXP01A71BY.9.2.A02.1.454.CMB.2.raw
  modified_base (507)..(507): a, c, t, g, unknown or other
  misc_feature (507)..(507): n is a, c, g, or t
tcagtgatacgtctcacgaccggtgctcgatttagactcatctacaggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttctctcggttgtctggcctcagtctgggaacacggcctccctgaccatctctggacttcagcctgaggacgagggtgattacttctgcagttcagattcgagtaaacttccctcgttgggtgttcggcggagggcctatgctgaaccgtcttgacgttcgagcccgaggcttcgcccctggtcnctcgttcgttccccgccgtcccg

SEQ ID NO: 358220 - DNA, 539 bp, Homo sapiens
  misc_feature: GZ8MTXP01EE4RE.9.2.A02.1.454.CMB.2.raw
  modified_base (519)..(519): a, c, t, g, unknown or other
  misc_feature (519)..(519): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaacgcccccaaatcataattatgatgtctttagacgcctcagggtatttcttctcggttgtctggcctccaagtctaggggaacaacgggcctccctgacccatctctggacttcagcctggaggacgagggtgattacttctgcagttcagtattcgaacgtaaacttcccctgttggggtcgttcggcgggagggacctatgctgaaccgtcttgagttcagccaaggcacgcccctggtccnctcttcgttccccgccgtcc

SEQ ID NO: 358221 - DNA, 534 bp, Homo sapiens
  misc_feature: GZ8MTXP01BRCD0.9.2.A02.1.454.CMB.2.raw
  modified_base (296)..(296): a, c, t, g, unknown or other
  misc_feature (296)..(296): n is a, c, g, or t
  modified_base (315)..(315): a, c, t, g, unknown or other
  misc_feature (315)..(315): n is a, c, g, or t
  modified_base (515)..(515): a, c, t, g, unknown or other
  misc_feature (515)..(515): n is a, c, g, or t
  modified_base (529)..(529): a, c, t, g, unknown or other
  misc_feature (529)..(529): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaatcataatttangatgtctttagacggcctnagggtatttcttctcggttgtctggcctccaagtctgggaacaacggcctcctgacccatctctggacttcagcctggaggacgagggtgattacttctgcagttcagtacttcgaagtaaaccttccctcggttgggtgttcggcggtagggcagtgctgaaccgtcttgagttcgagccaggccttcgcccctggtcnctcttccgttcccncctcc

SEQ ID NO: 358222 - DNA, 531 bp, Homo sapiens
  misc_feature: GZ8MTXP01CRNXD.9.2.A02.1.454.CMB.2.raw
  modified_base (302)..(302): a, c, t, g, unknown or other
  misc_feature (302)..(302): n is a, c, g, or t
  modified_base (321)..(321): a, c, t, g, unknown or other
  misc_feature (321)..(321): n is a, c, g, or t
  modified_base (334)..(334): a, c, t, g, unknown or other
  misc_feature (334)..(334): n is a, c, g, or t
  modified_base (362)..(362): a, c, t, g, unknown or other
  misc_feature (362)..(362): n is a, c, g, or t
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
  modified_base (462)..(462): a, c, t, g, unknown or other
  misc_feature (462)..(462): n is a, c, g, or t
  modified_base (514)..(514): a, c, t, g, unknown or other
  misc_feature (514)..(514): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactgggaaacgaatagcgaacattgggtggctctaatcatgtctcctggtactataacagtccaaggcaaagcccccaaatcaataatttangatgtctttagacggcctnagggtatttcttntcgttgtctggcctcaagtctgggaacncggcctcccgtgaccatctctggacttcagcctggaggacgagggtnattactntgctagttcagtattcgaacgtaaacttccctggttggtgttcggnggtagggccagtcgctgaacctcttgagttcacgccaggcttcgccctggcnctcttcgttccccgctc

SEQ ID NO: 358223 - DNA, 606 bp, Homo sapiens
  misc_feature: GZ8MTXP01ASKGO.9.2.A02.1.454.CMB.2.raw
  modified_base (298)..(298): a, c, t, g, unknown or other
  misc_feature (298)..(298): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgcctgactcagcctgccgccgtgtccgggtctcctggacagtcgatcaccatctcgtgcactggaaacgaatagcgacattggtggctctaaatcattgtctcctggtactataacagtccaggcaaagcccccaaatcataatttangatgtctttagacggtccctgagggtatttcttcttcggttgtctggcctccaagtctgggaacaacgggcctcccgtgacccatctctggacttcagcctggaggacgagggtgtattacttctgctagttcagtattcgaagtaaacctttccccgtcggtttgggtcgttcgggcgggtacgggacctagtcgacgtcggtaacccgtcgttagtacgttccgacggtccccgaaggttccgttccgccccccgttcgggtcctacccgttccgttcccgttcccccgttaaccccgtttccccg

SEQ ID NO: 358224 - DNA, 579 bp, Homo sapiens
  misc_feature: GZ8MTXP01AKSLK.9.2.A02.1.454.CMB.2.raw
tcagtgatacgtctcacgaccggtgctcgatttagactcatctacaggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtgctctaatcatgtctcctggtactataacagtccaggcaaagcccccaaatcataatttatgatgtctttagacggccctcagggatttcttctcggttgtctggcctccagtctgggaacacggcctccctgaccatctctggacttcagcctgaggcgagggtgattacttctgcagttcagtattcgagtaaacctttccccgtcggtttcggggtggttcgggcgggtaagggggccctagtcggcctggtaacccgtccgttggacgttcgacggcccccgaaaggggccttcggccccccttcgggtccgaccttccttcgtttcccccaacccgttccc

SEQ ID NO: 358225 - DNA, 864 bp, Homo sapiens
  misc_feature: GZ8MTXP01BYX8L.9.2.A02.1.454.CMB.2.raw
  modified_base (238)..(238): a, c, t, g, unknown or other
  misc_feature (238)..(238): n is a, c, g, or t
tcagtgatacgtctcacgaccggtgctcgatttagactcatctacgaggggggggtctcaggaggcagcgctctcgggacgtctccaccatggcctgggctctgctattcctcaccctcctcactcagtgtacagggtcctgggcccagtccgccctgactcagcctgccgcgtgtccgggtctcctggacagtcgatcaccatctcgtgcactggaaacgaatagcgactagttggnggctactaatcattgtctcctaggtaactataaacagtaccaaggaccaaaacgaccccccaaaatacaattaaatttatggtaattagttacttttaacggaaccggtccccttacgtaaggggttaactttttccgtttcgttccgggtttgtcgttggggtaccccttacccgtaaaaggttccgtagggggaaaacccaaacccggggtccccttccccttacggaaaccctaagttccctcgtacggggtaacctttccgaacggtcccgttagggaaaggggaaccgggtaaggggttaggttaaacgttttaaacctttccgtgggtacccttaacgggtttaaacgtaacgttaaaccgtttaaccgggtaaaaccggtttaaaccccggttttccccgggtttacgggggttttacgggggttaccggggttaccgggggaccggggtaaaccggggtaacccgtaggttccggtaccgtaccggtaacccggttccgttacggtaacgttaccgaaccggtaaccccggttaaccggttccccgttccccggtcccccggttcggtaaccctacccgttcccgttacccgttaacccccgttaaccccgttaaccg

SEQ ID NO: 358226 - DNA, 552 bp, Homo sapiens
  misc_feature: GZ8MTXP01BQLDA.9.2.A02.1.454.CMB.2.raw
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (530)..(530): a, c, t, g, unknown or other
  misc_feature (530)..(530): n is a, c, g, or t
  modified_base (544)..(544): a, c, t, g, unknown or other
  misc_feature (544)..(544): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagccccaaatcataatttangatgtctttagacggccctnagggattttctctcggttgtctggcctccaagtctggggaacaacgggccctcccgtgacccatctctggacttcagcctggaggacgagggtgattacttctgcagttcagattcgaacgtaaaccttccccgtaggttgggtcgttcgggcggagggtcctatcgctggaacccgtcttgacgttcgacgcccaaggccttcgcccctggtcncctcttccgtcccnccgttccc

SEQ ID NO: 358227 - DNA, 610 bp, Homo sapiens
  misc_feature: GZ8MTXP01BCSU9.9.2.A02.1.454.CMB.2.raw
  modified_base (234)..(234): a, c, t, g, unknown or other
  misc_feature (234)..(234): n is a, c, g, or t
  modified_base (265)..(265): a, c, t, g, unknown or other
  misc_feature (265)..(265): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (405)..(405): a, c, t, g, unknown or other
  misc_feature (405)..(405): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggnggctctaatcatgtctcctggtactataacngtccaggcaaagcccccaaatcataatttangatgtctttagacggccctnagggtatttcttctcggttgtctggcctcagtctgggacaacggcctccctgacccatctctggacttcagcctggaggacgagggttnattacttctgcagttcagtattcgaacgtaaacctttccccgtggtttggggttcgttcggggcgggtacggggacctagtcgaccgtggtaacccggttcgttggtacggttccgaacggtccccgaagggttcccttccgggcccccccgttcggggtccctacccgttccgttccggtttccccccgaaccccgtttccccg

SEQ ID NO: 358228 - DNA, 574 bp, Homo sapiens
  misc_feature: GZ8MTXP01B3BLF.9.2.A02.1.454.CMB.2.raw
  modified_base (229)..(229): a, c, t, g, unknown or other
  misc_feature (229)..(229): n is a, c, g, or t
  modified_base (317)..(317): a, c, t, g, unknown or other
  misc_feature (317)..(317): n is a, c, g, or t
  modified_base (483)..(483): a, c, t, g, unknown or other
  misc_feature (483)..(483): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcganattggtgctctaatcatgtctcctggtactataacagtccaggcaaacgccccaaactcataatttatgatgtctttagacggccctnagggtatttcttctcggtttgtctggtccctccgaaagtcgtaggggtaaccaaccgggccctcccgtgaccctatctctggacttcagcctggaggacgagggtgatttactctgctagttcagtattcgagtaaacctttcccgtggtttcgggtggttcgggnggtaacggggcctgtcgctgaaccgttcttggacgttcgacgccaggccttccgcccctcggtcctacgtcttcgttccccaacccttccg

SEQ ID NO: 358229 - DNA, 608 bp, Homo sapiens
  misc_feature: GZ8MTXP01DNB6M.9.2.A02.1.454.CMB.2.raw
  modified_base (234)..(234): a, c, t, g, unknown or other
  misc_feature (234)..(234): n is a, c, g, or t
  modified_base (317)..(317): a, c, t, g, unknown or other
  misc_feature (317)..(317): n is a, c, g, or t
  modified_base (597)..(597): a, c, t, g, unknown or other
  misc_feature (597)..(597): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgatagcgacattggnggctctaatcatgtctcctggtactataacagtccaggcaaacgcccccaaatcataatttatgatgtctttagacggccctnagggtatttcttctcggtttgtctggcctccaagtcgtagggtaacaaccggccctccctgacccagttctctgggtcttcagccgtggagggacgagggtgtattacttctgtctagttcaagtattacgaaacgtaaacctttccccgttccgggttggggttcgtttcgggcgggtaacggggccctaagtcgtccgtcggtaacccgtccttggtacgttcgacgcccgaacggccttccgtccccgttcggtcctacctcccgttccgttccccncccgttccccg

SEQ ID NO: 358230 - DNA, 637 bp, Homo sapiens
  misc_feature: GZ8MTXP01DLTC7.9.2.A02.1.454.CMB.2.raw
  modified_base (370)..(370): a, c, t, g, unknown or other
  misc_feature (370)..(370): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaacgcccccaaactcataatttatgatgtctttagacggccctgagggtatttcttctcggttgtctggcctcaagtctggaacacggcctcccngaccatctctggacttcagcctggaggacgagggtgtattacttctgactagttcagtacttacgaacgttaaacctttccccgttcgggtttcggggttcggtttccgggacggggtaacgggggtaccctaaggttcgaccgttcggaacccgttcccgttggtaacgttccgaaccggccccgaacgggttcccgttccggtcccccccgttcgggttccctacccgttcccgttcccggtttccccccggcccctttccccgg

SEQ ID NO: 358231 - DNA, 561 bp, Homo sapiens
  misc_feature: GZ8MTXP01A0JMY.9.2.A02.1.454.CMB.2.raw
  modified_base (235)..(235): a, c, t, g, unknown or other
  misc_feature (235)..(235): n is a, c, g, or t
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
  modified_base (365)..(365): a, c, t, g, unknown or other
  misc_feature (365)..(365): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgcctgactcagcctgccgccgtgtccgggtctcctggacagtcgatcaccatctcgtgcactggaacgaatagcgacagttggnggctctaatcattgtctcctggtactataacagtcaggcaaagcccccaaatcataattangatgtcttagacgcctnagggtatttctctcggttgtctggcctccaagtctgggaacacggcctcccngaccatctcgtggacttcagcctggacggacgagggtgtattacttcgtgacgtagttcagtacttacgaacgtaaacctttccccgttaggttgggtcgttcgggcggtaacggacctagtcgcgtcgaaccgtcttggagttcgacgcccaggccttccgccccgtcggtccacgtccttcgtcccgccctccg

SEQ ID NO: 358232 - DNA, 782 bp, Homo sapiens
  misc_feature: GZ8MTXP01C9OST.9.2.A02.1.454.CMB.2.raw
  modified_base (297)..(297): a, c, t, g, unknown or other
  misc_feature (297)..(297): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacgaatagcgacattggtggctctaatcatgtctcctggtactataacagtcaggcaaacgcccccaaatcataatttangtatgtctttagaccggcctcgagggttatttcgttcgtcggtttcgtcgtggtcccttaccaaagttcgtgggaaaccaaccgggtcccttcccgtgaaccctattcctcgttcgggtaaccttcaacggtcccgttaggaacgggtacgggtaaggggttaggtaacgtttaacctttcgtcgtacgttacggtttaccaaagggttaactttaacccggaaacggtttaaaaccccgtttcccccgtttacggggtttacggggttccgggtttccgggggaccggggttaaacgggggaacccctaagttcgggtccgttaccggtaaaccccgggttcccgttagggtaacgttaccggaaacccggccccggttaaaagggttccccgttaccccggggttaacccccccttaccggggttcccgttaaccccgttccctttacccgggtttcccccgttaaacccccgtttaaccccg

SEQ ID NO: 358233 - DNA, 584 bp, Homo sapiens
  misc_feature: GZ8MTXP01D1C6L.9.2.A02.1.454.CMB.2.raw
  modified_base (316)..(316): a, c, t, g, unknown or other
  misc_feature (316)..(316): n is a, c, g, or t
  modified_base (416)..(416): a, c, t, g, unknown or other
  misc_feature (416)..(416): n is a, c, g, or t
  modified_base (577)..(577): a, c, t, g, unknown or other
  misc_feature (577)..(577): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacaatagcgacattggtgctctaatcatgtctcctggtactataacagtccaggcaaaacgcccccaaatcaataatttatgatgtctttagacgcctnagggtatttcttctcggttgtctggcctccaagtcgtgggaaccaaccgggcctccctgaccctatcctctggacttcacgtcctggaggacggagggtntaattacttctgctagttcagtattacgaacgtaaacctttccccgttaggtttggggtcggttcgggacgggtacgggtaccctagtcgtacgtcggaaccgttccgttggacgttcgacggcccaaggccttcgcccctggtccactcttccgttcccnccctccg

SEQ ID NO: 358234 - DNA, 547 bp, Homo sapiens
  misc_feature: GZ8MTXP01A6JL4.9.2.A02.1.454.CMB.2.raw
  modified_base (263)..(263): a, c, t, g, unknown or other
  misc_feature (263)..(263): n is a, c, g, or t
  modified_base (293)..(293): a, c, t, g, unknown or other
  misc_feature (293)..(293): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (373)..(373): a, c, t, g, unknown or other
  misc_feature (373)..(373): n is a, c, g, or t
tcagtgatacgtctcacgaccggtgctcgatttagactcatctacaggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctctggtactataacngtccaggcaaagccccaaatcataatttangatgtcttagacgcctnagggtntttcttctcgttgtctaggcctccaagtctagggaacaacgcctcctgaccatctcnggacttcagctgaggacgagggtgattacttctgcagttcagacttcacgtaaacttccccgtagttgggtgttcggcggtaggggcctagttcgcgtgaaccgttccttgacgttcgacggcccaagggccttcggcccctggtccacgtcttccgtccccttaacccgttcc

SEQ ID NO: 358235 - DNA, 603 bp, Homo sapiens
  misc_feature: GZ8MTXP01D20W1.9.2.A02.1.454.CMB.2.raw
  modified_base (202)..(202): a, c, t, g, unknown or other
  misc_feature (202)..(202): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgcctgactcagcctgccgccgtgtccgggtctcctggacagtcgatcacntctcgtgcactggaacaatagcgactagttgggtgctactaatcattgtctcctaggtactataacagtccaggacaaacgacccccaaatcaattaattatgtatgttactttagaccggtcctagtagggttactttcgttcttcggttgtcgtcggtcctaccgtaagtcgtacgggaaccaccgggtccctcccgtgacctactcctctcggtacttcacgtccgtaggacggacggtaggtgtaactttctgtgctagttcagtacttacgaacgttaacctttcccgtgggttgggtcggttcgggacggtacgggctagtgtcgtcggtcctcgttgacgttcgacgcccgagcgttccgccccgtgtcctctcgttccgtcccaacccgtccg

SEQ ID NO: 358236 - DNA, 576 bp, Homo sapiens
  misc_feature: GZ8MTXP01DP2BZ.9.2.A02.1.454.CMB.2.raw
  modified_base (135)..(135): a, c, t, g, unknown or other
  misc_feature (135)..(135): n is a, c, g, or t
  modified_base (237)..(237): a, c, t, g, unknown or other
  misc_feature (237)..(237): n is a, c, g, or t
  modified_base (268)..(268): a, c, t, g, unknown or other
  misc_feature (268)..(268): n is a, c, g, or t
  modified_base (300)..(300): a, c, t, g, unknown or other
  misc_feature (300)..(300): n is a, c, g, or t
  modified_base (319)..(319): a, c, t, g, unknown or other
  misc_feature (319)..(319): n is a, c, g, or t
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
  modified_base (380)..(380): a, c, t, g, unknown or other
  misc_feature (380)..(380): n is a, c, g, or t
  modified_base (424)..(424): a, c, t, g, unknown or other
  misc_feature (424)..(424): n is a, c, g, or t
  modified_base (504)..(504): a, c, t, g, unknown or other
  misc_feature (504)..(504): n is a, c, g, or t
  modified_base (547)..(547): a, c, t, g, unknown or other
  misc_feature (547)..(547): n is a, c, g, or t
tcagtgatacgtctcacgaccggtgctcgatttagactcatctacgaggggggggtctcaggaggcagcgctctcgggacgtctccaccatggcctgggctctgctattcctcaccctcctcactccagtgtacngggtcctgggcccagtccgcctgactcagcctgccgccgtgtccgggtctcctggacagtcgatcaccatctcgtgcacgtggaacgaatgcgacagttggngctactaatcatgtctcctggtactataacngtccaggacaaacgccccaaatcataatttangatgtctttagacggcctnagggtatttctctcggttntctggtccnccaagtcgtagggaacctaaccgggcctccgtnacccagtctactggacttcacgctggaggacgaggtgattactntgctagtcagtacttcaacgtaaactttccccgtggttggtcgttcggcggaagggtacctatcgctcgaaccgttccgnggcgttcgacggcccgttaacgccttccgccccctggtaaccncgtcgttccgtccccgttaaccgttcccg

SEQ ID NO: 358237 - DNA, 577 bp, Homo sapiens
  misc_feature: GZ8MTXP01A8C6F.9.2.A02.1.454.CMB.2.raw
  modified_base (299)..(299): a, c, t, g, unknown or other
  misc_feature (299)..(299): n is a, c, g, or t
  modified_base (316)..(316): a, c, t, g, unknown or other
  misc_feature (316)..(316): n is a, c, g, or t
  modified_base (364)..(364): a, c, t, g, unknown or other
  misc_feature (364)..(364): n is a, c, g, or t
  modified_base (410)..(410): a, c, t, g, unknown or other
  misc_feature (410)..(410): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgtcgccgtgtccgggtctcctggacagtcgatcaccatctcgtgcactggaaacgaatagcgacattggtggctctaatcatgtctcctggtactataacagtccaggcaaacgcccccaaatcataatttangatgtcttagacgcctnagggtatttctctcgttgtctggcctcagtctggaacacggcctcccngaccatctctggacttcagcctggaggacggagggtgtattacttntgctagttcagtattcgaacgtaaacctttccccgtaggttgggtgttcgggcggacgggacctagtcgcgtcgtaaccgtcgttggacgttcgacgtcccgaacggccttccggtcccccgtcggtcctaccttccgttcccgttcccccgttaaccccgttcccg

SEQ ID NO: 358238 - DNA, 621 bp, Homo sapiens
  misc_feature: GZ8MTXP01EJV4G.9.2.A02.1.454.CMB.2.raw
  modified_base (369)..(369): a, c, t, g, unknown or other
  misc_feature (369)..(369): n is a, c, g, or t
  modified_base (403)..(403): a, c, t, g, unknown or other
  misc_feature (403)..(403): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctgtgcactggaacgaatagcgacagttggtggctctaatcatgtctcctggtactataacagtccaggcaaacgccccaaatcataatttatgatgtctttagacggcctgagggtattttctcttcggttgtctggcctccaagtctgggaacacggcctccngaccatctctggacttcagctgaggacgagggtntatttacttctgactagttcaagtactttacgaacgttaaacctttccccgttggtttcgggtcggtttcgggacgggaacgggtaccctagttcgccgttcggaacccgttcgttacggtacgttccgaacggtccccgaaggggttcccttacccggccccccgttcggtcctacccgttccgttccccgtttaaccccccgaacccgtttccccg

SEQ ID NO: 358239 - DNA, 637 bp, Homo sapiens
  misc_feature: GZ8MTXP01ASXQ0.9.2.A02.1.454.CMB.2.raw
  modified_base (235)..(235): a, c, t, g, unknown or other
  misc_feature (235)..(235): n is a, c, g, or t
  modified_base (299)..(299): a, c, t, g, unknown or other
  misc_feature (299)..(299): n is a, c, g, or t
  modified_base (418)..(418): a, c, t, g, unknown or other
  misc_feature (418)..(418): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgcctgactcagcctgccgccgtgtccgggtctcctggacagtcgatcaccatctcgtgcactggaacgaatagcgacagttggngctctaatcatgtctcctggtactataacagtccaggacaaacgcccccaaatcaataatttangatgtcttagacgcctgagggtactttctcgtcgttgtctggccctcaagtcgtagggaaccaacggccctcctgaccctatctcgtggacttcacgtccgtggaggtacggagggttntacttacttcgtgctagttccaagtacttacggaacgtaaaccgtttccccgttggttgggtcgttcgggcggtacggacctagtcgtccgtcgtaacccgtcgttaggtacgttaccgaaccggcccgttaaacgggttcccttaccccggtccccccgttcggtaaccctccccgttccgttcccccggttaacccccgttcccccgtttaaccccg

SEQ ID NO: 358240 - DNA, 646 bp, Homo sapiens
  misc_feature: GZ8MTXP01AWJ7Q.9.2.A02.1.454.CMB.2.raw
  modified_base (338)..(338): a, c, t, g, unknown or other
  misc_feature (338)..(338): n is a, c, g, or t
  modified_base (364)..(364): a, c, t, g, unknown or other
  misc_feature (364)..(364): n is a, c, g, or t
  modified_base (414)..(414): a, c, t, g, unknown or other
  misc_feature (414)..(414): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgcgtgtccggtctcctggacagtcgatcaccatctcgtgcactggaacaatagcgacattggtgctctaatcatgtctcctggtactataacagtccaggacaaacgcccccaaactcaataatttatgatgtctttagacggcctcgagggtattttcgtcttcggttntctggcctcaagtcgtaggggaaccncggtccctcctacgaccatctctcggacttcagcctggaggacgagggtnagttacttcgtagctagttcagtacttcgaagtaaacctttccccgtacggtttggggtcggtttcgggacgggacgggtacctacgtggtccgtcggtaaccccggttccgttagggtacgttccgaccgggtaccccgaaacgggttccccgttcccggtccccccccggttccggggtcccttacccgttcccgtttcccggttttcccccggttccccctttcccccg

SEQ ID NO: 358241 - DNA, 539 bp, Homo sapiens
  misc_feature: GZ8MTXP01D3GP0.9.2.A02.1.454.CMB.2.raw
  modified_base (333)..(333): a, c, t, g, unknown or other
  misc_feature (333)..(333): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgcctgactcagcctgccgccgtgtccggtctcctggacagtcgatcaccatctcgtgcactggaacgaatagcgacattggtgctctaatcatgtctcctggtactataacagtccaggcaaagccccaaatcataattatgatgtctttagacggtcctcgagggtatttcttctcggtttntctggcctccaaagtcgtgggaacaacggcctcccgtgaccatctctggacttcagctgaggacgagggtgtaattacttctgctagttcagtattcaagtaaacctttccctcggttgggtgttcggcggtagggcctagtgctgaaccgtcttgacgttgacgcccaaggcttcgcccctcggtcactcttgtttccccgcctc

SEQ ID NO: 358242 - DNA, 684 bp, Homo sapiens
  misc_feature: GZ8MTXP01BRBG3.9.2.A02.1.454.CMB.2.raw
  modified_base (313)..(313): a, c, t, g, unknown or other
  misc_feature (313)..(313): n is a, c, g, or t
tcagtgatacgtctcacgaccggtgctcgatttagactcatctacgaggggggggtctcaggaggcagcgctctcgggacgtctccaccatggcctgggctctgctattcctcaccctcctcactcagtgtacagggtcctgggcccagtccgcctgactcagcctgccgccgtgtccggtctcctggacagtcgatcaccatctcgtgcactggaaacgaatagcgactagttgggtcggctactaaatccattgtctcctaggtaactataacagtacaggacaaaacgcccccaaatctaataattttangtattcgttacttacgaccgtcctagtaggttactttcgttcgttcggttcgtcgtacggtccctaccgtaagtcggtaacggaaccgtaaccgtccctccgtagacctactccgtacgtacgtacttcacgtcgtaggaacgggacggtaggttacgttacgttacgttacgtacgacttagtacgtaagttacttacggtaaacgttaacccgttccggttacgggttcgggtcggtacgggtacggtaacggtacgtacgtcgtcgtccggtaaccgtcgttcgtacgaccgtacgaccgttacgttcccgttcccgtccccgtccgtaacctaccgttccgttacccgttccccgttcccgtaaccg

SEQ ID NO: 358243 - DNA, 592 bp, Homo sapiens
  misc_feature: GZ8MTXP01CM46J.9.2.A02.1.454.CMB.2.raw
  modified_base (297)..(297): a, c, t, g, unknown or other
  misc_feature (297)..(297): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacgaatagcgacattggtggctctaatcatgtctcctggtactataacagtccaggcaaacgcccccaaatcataattntgatgtctttagacggtcctgagggtatttcttctcggttgtctggccctcagtcgtggaacacggtccctcccgtgaccctatctcgtggtacttcgagtccgtaggagggtacggagggtgtattacgttctgtcgtagttacagtacttacgtaaacgtaaaccctttcccgttacggttgggtcggttcgggacggtacgggacctagtcgcgtcgaaccgtcgttgacgttcgacgcccgaggttccttccgcccctcggtcctcctccttccgttccccgccgttcccg

SEQ ID NO: 358244 - DNA, 632 bp, Homo sapiens
  misc_feature: GZ8MTXP01AQ2EM.9.2.A02.1.454.CMB.2.raw
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
  modified_base (369)..(369): a, c, t, g, unknown or other
  misc_feature (369)..(369): n is a, c, g, or t
tcagtgatacgtctcacgaccggtgctcgatttagactcatctacgaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgactagttgggtgctctaatcatgtctctggtactataacagtcaggcaaacgccccaaatcataatttangatgtctttagacgtcctnagggtatttctgtcgttgtctggcctacagtcgtaggaacaccggcctccgngaccatcctcgtggtacttcgacgccgtaggacggacggtaagggtgtaacgtttacttcgtgtactagttacagtacttacgtaacggtaaacccgtttccccgttcgggtttgggtacggtttccggggacggtacggggtaccctaagttcgccgttcggtaacccgtcttgggtacgccgtaacgacccgaacggttccgttcccgcccccgtcggtccctaccgttccgttacccggttccccaacccgtttaacccg

SEQ ID NO: 358245 - DNA, 656 bp, Homo sapiens
  misc_feature: GZ8MTXP01BMLZA.9.2.A02.1.454.CMB.2.raw
  modified_base (245)..(245): a, c, t, g, unknown or other
  misc_feature (245)..(245): n is a, c, g, or t
  modified_base (271)..(271): a, c, t, g, unknown or other
  misc_feature (271)..(271): n is a, c, g, or t
  modified_base (324)..(324): a, c, t, g, unknown or other
  misc_feature (324)..(324): n is a, c, g, or t
  modified_base (370)..(370): a, c, t, g, unknown or other
  misc_feature (370)..(370): n is a, c, g, or t
tcagtgatacgtctcacgaccggtgctcgatttagactcatctacgaggggggggtctcaggaggcagcgctctcgggacgtctccaccatggcctgggctctgctattcctcaccctcctcactcagtgtacagggtcctgggcccagtccgccctgactcagcctgccgccgtgtccgggtctccgtggacagtcgatcaccatctcgtgcacgtggaaacgaatagcgactagttggtgctntaatcattgtctcctgtactataacngtcaggcaaacgccccaaatcaataatttatgatgtcttagacgcctgaggtntttcttcttcgtgtctggcctactagtctaggaccaacgccctccngacctatctctggtacttcacgtccgtaggacgggtaacggtagggggtataaacgtttcgttcgtacggtacgttaacgttcgtaagtaacgttaccggtaaacgttaaaccccgtttccccgttcggggtttacggggttcggttccgggggtacggaacgggggtacctagtcggtcgtaccggtaaccgtccgttggtaccgttcgaaccggtacccgacggttccgttccccgtaaccctcgggtcctacccgtccttaccgttccccgttaaccttcccg

SEQ ID NO: 358246 - DNA, 698 bp, Homo sapiens
  misc_feature: GZ8MTXP01BG2YC.9.2.A02.1.454.CMB.2.raw
  modified_base (277)..(277): a, c, t, g, unknown or other
  misc_feature (277)..(277): n is a, c, g, or t
  modified_base (311)..(311): a, c, t, g, unknown or other
  misc_feature (311)..(311): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtcccgccctgactcagcctgccgccgtgtccgggtctcctggacagtcgatcaccatctcgtgcacgtggaaacgaatagcgactagttgggtggctactaatcattcgtcttcctggtactataacngtccaggacaaacgccccaaatcaattaatttangattgttctttagaccggccccttagagggttacttttcttcgtcggtttgtcgtcgtcccctaccgtaagtcggtacgggaaccctaacccgggtcccttcccgtcgaaccctattcccgttcgttacgggtaccctttaccgacggtcccgtagggacggggtacggtaggggttagtaacgtttacttcgtggactacgttcaagttacttacggtaacgttaaaccccgtttccccgttacgggtttcgggtcgggttccggggacgggtaacgggtcctaaggtcgtcgtcgtcccgttcaggtcttacgaccgacccggacgccgttcccgtccccgttacgtccgaccttccgttccgttaacccccttccgttaacccg

SEQ ID NO: 358247 - DNA, 588 bp, Homo sapiens
  misc_feature: GZ8MTXP01EZ3YT.9.2.A02.1.454.CMB.2.raw
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (269)..(269): a, c, t, g, unknown or other
  misc_feature (269)..(269): n is a, c, g, or t
  modified_base (522)..(522): a, c, t, g, unknown or other
  misc_feature (522)..(522): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacgaatagcgacagttggnggctntaatcatgtctcctggtactataacngtccaggcaaacgcccccaaatcaattaatttatgatgtctttagaccggtccctgagggtatttcgttctcggttgtctggccctccgtaagtcgtagggaaccaaccgggtccctcccgtagaccctatctcgtggacttcagtccgtggaggacgagggtatattacttctgactagttacagtattacgaacgtaaaccttcccgtaggttgggtacgtcgggcggacggctagtcgctcgaaccgtcngcgttcgacgcccgaagccttaccgtccccgtcggtcctacgtcgttcccgtcccgttccctcccg

SEQ ID NO: 358248 - DNA, 610 bp, Homo sapiens
  misc_feature: GZ8MTXP01DAQZU.9.2.A02.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (306)..(306): a, c, t, g, unknown or other
  misc_feature (306)..(306): n is a, c, g, or t
  modified_base (373)..(373): a, c, t, g, unknown or other
  misc_feature (373)..(373): n is a, c, g, or t
  modified_base (456)..(456): a, c, t, g, unknown or other
  misc_feature (456)..(456): n is a, c, g, or t
  modified_base (542)..(542): a, c, t, g, unknown or other
  misc_feature (542)..(542): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcacgtaggaaacgaatgcgaacagtttgggngtctntaaatcattcgtctctagtactataacagtcaggacaaacgccccaaatcaatatttantatgtcttacgacgcctgaggttcttcgttctcggttgtctcggtccctacgaagttcgacggaacncccggtccctcccgtagacctacttcgtcgtacgggtactcacggtccgtaggacgggacggtagggttgtaatttacgttcngtctagtactagtactacgtaacgttaaccgttccgttaggttgggtcggttcgggacggtacggtactgtcgaccgtcgtccgtnttcggcgttcgacggtccacggcttcccgtccccgtcggtcctctccgttcccgtccccgcccttccg

SEQ ID NO: 358249 - DNA, 776 bp, Homo sapiens
  misc_feature: GZ8MTXP01EKN9E.9.2.A02.1.454.CMB.2.raw
  modified_base (210)..(210): a, c, t, g, unknown or other
  misc_feature (210)..(210): n is a, c, g, or t
  modified_base (251)..(251): a, c, t, g, unknown or other
  misc_feature (251)..(251): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgccctgactcagcctgccgccgtgtccggtctcctggacagtcgatcaccatctcgtnacactaggaacgaatagcgactagttggtgctataatcatntctctgtactataacagtacagacaaacgaccccaaactcaattaattatgtatcgttactttacgaccgtcctagtagggttacttttcgttcgttcgttgtcgtcggtccctacagtcgtaggaccaacggccctccgngacctntctcgtcggacttcgacgtccgtaggacgggacgttacggggttattaacgttttaccttagtcgtaacgttacggttactaaacggttactttaacggggtaaaccgtttaaaccccggttttcccccggtttgggggttttacgggggttccggggtttaaccgggggacccgggggtaaaacgggtaccccttaaacggggttccgttaccggttaacccgggtcccggttaccggtttacgggaccgttaaaccgaaccgggtaaccccgggttaacggttcccccggttaccccgtccccccgggtttacgggttaaccccttcccgttccccgtttaccccgtttcccccccggttaacccctttaacccgg

SEQ ID NO: 358250 - DNA, 746 bp, Homo sapiens
  misc_feature: GZ8MTXP01EINE7.9.2.A02.1.454.CMB.2.raw
  modified_base (211)..(211): a, c, t, g, unknown or other
  misc_feature (211)..(211): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtncacgtaggaaacgaatagcgaactagttgggtggctactaatctatgtctccgtaggtaactaataacgagtaccaggaccaaaaccgaccccctaaatctaattaatttatgtagttcgttacgtttaacggaccggtccctacggtagggtttacttttcgttcgttcggtttcgtcgtcggtccccttaccgtaaggtccgtacggggaacccgtaacccgggtccctcccgtcgaaccctacttcctacgtacgggtactttcgacgtcccgtaggacgggtacggtagggttacgttactttacgtcgtcgacgttacgttacgaaggttacttaaccggtaaccgtttaaacccgtttccccgtttggggtttaccggggttcggttcccgggggtacgggtaaacggggtacctaggtccggtaaccgtccggtaacccgttcgagtaccgttcgaccgtacccgaccggttcgttcccgtccccgttaggtccctccgttcccgttcccgttccccgttccgtcccg

SEQ ID NO: 358251 - DNA, 785 bp, Homo sapiens
  misc_feature: GZ8MTXP01AJSOD.9.2.A02.1.454.CMB.2.raw
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcaacgtggaaacgaatagcgactagttgggtggctactaatcatgtctccgtaggtactaataacagtaccaggacaaaccgacccccaaatctaattaatttatgtattgttactttaacgaccggtccctagtagggttacttttcgttcgttcgggttgtcgtcggtaccctaccgtaaaggtccgtacggggaaccgtaacccgggtcccttcccgtacgaccctacttccgtacgtacgggtacttcgacgtccgtaggacgggtacgggtaagggttacgttaacgtttacgttcgtcgtaccgttagttctaagttaacttaccggtaaacgttaaaccccgtttccccgttacggggtttcggggttcggttcccgggggacgggtaaccgggtaaccgtaggttccgtccggttccggtaaccccggttccggttacggaaccggttccgaacccggtacccgttaaccggggttccccgttccccgggttcccccccggttaccggggtcccttaaccccgttcccggtttaccccggttcccccgttaaccccctttccccgg

SEQ ID NO: 358252 - DNA, 667 bp, Homo sapiens
  misc_feature: GZ8MTXP01EINL9.9.2.A02.1.454.CMB.2.raw
  modified_base (342)..(342): a, c, t, g, unknown or other
  misc_feature (342)..(342): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacgaatagcgactagttgggtggctctaatcatgtctcctggtactataacagtcaggacaaacgcccccaaatcaataatttatgatgtcttagcgcctgagggtatttcttcgttcggttntctggtccctcctaaagtcgtagggaaccaacccggccctcccgtgaccctatcctcgtggactttcgagtccgtggacgggacggtagggtgttaactttacgttctgtacgtagttcaagtacttacggtaaacgttaaacccgtttccccgttcgggtttcggggtcgtttccggggacgggtaacgggtccgtaagtcggtccgtccggaacccgttccgttaggtaccgttaccgaaccggcccgttaacgggcccttccccggcccccgttcccgggtccttcccgtcccgttccccgttcccccgttccctttccccg

SEQ ID NO: 358253 - DNA, 528 bp, Homo sapiens
  misc_feature: GZ8MTXP02I3PEP.9.2.A02.1.454.CMB.2.raw
  modified_base (401)..(401): a, c, t, g, unknown or other
  misc_feature (401)..(401): n is a, c, g, or t
tcagtgatacgtctcacgaccggtgctcgatttagactcatctacaggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaatcataatttatgatgtctttagacggccctcagggtatttcttctcggttgtctggcctccaagtctgggaacacggcctcctgaccatctctggacttcagcctgagacgagggtnattacttctgcagttcagattcagtaacttcccctggttgggtgttcgggcggagggaccagtgcgtcgaccgtcctgacgtcacgcccaaggcctcgccccgtcggtcactctcgtcccaccctcc

SEQ ID NO: 358254 - DNA, 531 bp, Homo sapiens
  misc_feature: GZ8MTXP02IR4UF.9.2.A02.1.454.CMB.2.raw
tcagtgatacgtctcacgaccggtgctcgatttagactcatctacagggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggtatttcttctcggttgtctggcctccaagtctgggaacacggcctcctgaccatcctctggacttcagcctgaggacgagggtgattacttctgcagttcagtattcagtaaaccttcccctggttcgggtgttcggcgggtagggaccagtcgctgaccgtctgacgtcacgcccaagcctcgccccgtcggcactctcgttcccacctcc

SEQ ID NO: 358255 - DNA, 598 bp, Homo sapiens
  misc_feature: GZ8MTXP02J0387.9.2.A02.1.454.CMB.2.raw
  modified_base (296)..(296): a, c, t, g, unknown or other
  misc_feature (296)..(296): n is a, c, g, or t
tcagtgatacgtctcacgaccggtgctcgatttagactcatctacaggggggtctcaggaggcagcgctctcgggacgtctccaccatggcctgggctctgctattcctcaccctcctcactcagtgtacagggtcctgggcccagtccgccctgactcagcctgtcgccgtgtccgggtctcctggacagtcgatcaccatctcgtgcactggaacgaatagcgacattggtggctctaatcatgtctcctggtactataacagtccaggcaaagcccccaaactcataatttangatgtctttagacggcctcagggtatttctctcggttgtctggcctccaagtctgggaacacggcctcctgaccatctctggacttcagcctgaggacgagggtgattactctgcagttcagtattcaagtaaacctttccccgtaggtttggggtcgttcggggacgggacggggaccctagtcggtccgtcggtaccccgttccgtggacgttaccgaacggcccccgaaagggtcccttaccggcccccccgttcgggtcccaccgttcccgtaccggtttccccccaccctttccccg

SEQ ID NO: 358256 - DNA, 539 bp, Homo sapiens
  misc_feature: GZ8MTXP02HHO1R.9.2.A02.1.454.CMB.2.raw
tcagtgatacgtctcacgaccggtgctcgatttagactcatctacagggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggtatttcttctcggttgtctggcctccaagtctggggaacacggcctccctgaccatctctggacttcagtcctgaggacgagggtgattactctgcagttcagattcagtaaactttccccgtggtttgggtcgttcgggcggagggaccatgctcgaccgtcctgacgtcacgtcccgaggcctcgcccccgtggtccacgtctcgttccccgcctccc

SEQ ID NO: 358257 - DNA, 546 bp, Homo sapiens
  misc_feature: GZ8MTXP02H6S2T.9.2.A02.1.454.CMB.2.raw
  modified_base (540)..(540): a, c, t, g, unknown or other
  misc_feature (540)..(540): n is a, c, g, or t
tcagtgatacgtctcacgaccggtgctcgatttagactcatctacaggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacgaatagcgacattggtgctctaatcatgtctcctggtactataacagtccaggcaaagcccccaaatcataatttatgatgtctttagacggccctcagggtatttctctcggttgtctggctccaagtctggggacacggcctcctgaccatctctggacttcagcctgacggacgagggtgtattacgttctgcagttcagtatttcaagtaaaccttcccgtcggtttgggtcgtttcgggcggagggacctagtcgctacgaccggtctgacgtcacgtccgaaggctcgccccctcggtcacgtctcggttcccccncctccg

SEQ ID NO: 358258 - DNA, 608 bp, Homo sapiens
  misc_feature: GZ8MTXP02GGB8F.9.2.A02.1.454.CMB.2.raw
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtgctctaatcatgtctcctggtactataacagtccaggcaaacgcccccaaatcaataattatgatgtctttagacggccctcgagggtactttcttcgtcggttgtctggccctaccaagtctaggggaacaccggcctcccgtgacctatctctggacttcagcctgagacgaggtgtattacttctgctagttcagtattacaacggtaaaccttccccgttcgggtttacgggtcggtttccggggacgggtacggggaaccagtcggtcgtacggtacccggttccgtaggtacgtccgaacgaccccgaaggtccgtccgtcccccgtcggtacctaccgtccgttccgttcccccggtacccttcccg

SEQ ID NO: 358259 - DNA, 578 bp, Homo sapiens
  misc_feature: GZ8MTXP02F6LKK.9.2.A02.1.454.CMB.2.raw
  modified_base (410)..(410): a, c, t, g, unknown or other
  misc_feature (410)..(410): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagccccaaatcataatttatgatgtctttagacggcctcagggtatttcttctcggttgtctggcctccaagtctgggaacacggctccctgaccatctctggacttcagcctgaggacgagggtgattacttcngcagttcagtattcacgtaaacttccccgtaggtttgggtcgttcggacgggtagggaccctagtcggctcggtaccgtccgtaggacgttccgacgtaccccgaacggccgttccggcccccgtcgggtccctaccttccgttccggtttcccccaccctttccccg

SEQ ID NO: 358260 - DNA, 584 bp, Homo sapiens
  misc_feature: GZ8MTXP02H0B22.9.2.A02.1.454.CMB.2.raw
tcagtgatacgtctcacgaccggtgctcgatttagactcatctacaggggggtctcaggaggcagcgctctcgggacgtctccaccatggcctgggctctgctattcctcaccctcctcactcagtgtacagggtcctgggcccagtccgcctgactcagcctgccgccgtgtccgggtctcctggacagtcgatcaccatctcgtgcactggaaacgaatagcgacattgggtgctctaatcatgtctcctggtactataacagtccaggcaaagccccaaactcataatttatgatgtctttagacgcctcagggatttctctcgttgtctggcctcaagtctgggaacacggctcctgaccatctctggacttcagcctgaggacgagggtgtatttacttctgtactagtttcagtacttacgaagttaaacccttccccgttcggttggggtgtttccgggcgggtacggggaccatggccgtacgtacccggtccttggacgttcgacgacccgaacggtccgttccgcccccgttcggtaccctaccgtcgtttacccgttcccctaacccctcccg

SEQ ID NO: 358261 - DNA, 562 bp, Homo sapiens
  misc_feature: GZ8MTXP02GF94I.9.2.A02.1.454.CMB.2.raw
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtgctctaatcatgtctcctggtactataacagtccaggcaaagcccccaaatcaataatttatgatgtctttagacggccctcagggtatttcttctcggttgtctggcctccaagtctgggaacacggcctccctgaccatcctctggacttcagcctgaggacgagggtgtattacttctgctagttcaagtattacgaagtaaacctttccccgtaggtttgggtcgttcgggacggaggggtaccagtcgcgtcgaccgtcctgacgtcacgacccgaaggccttccgcccccgtcggtccactccgtcgttccccacctttccg

SEQ ID NO: 358262 - DNA, 526 bp, Homo sapiens
  misc_feature: GZ8MTXP02I3NOM.9.2.A02.1.454.CMB.2.raw
  modified_base (232)..(232): a, c, t, g, unknown or other
  misc_feature (232)..(232): n is a, c, g, or t
  modified_base (395)..(395): a, c, t, g, unknown or other
  misc_feature (395)..(395): n is a, c, g, or t
  modified_base (488)..(488): a, c, t, g, unknown or other
  misc_feature (488)..(488): n is a, c, g, or t
tcagtgatacgtctcacgaccggtgctcgatttagactcatctacagggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggnggctctaatcatgtctcctggtactatacagtcaggcaaacgccccaaactcataatttatgatgtctttagacggccctcagggtatttcttctcgttgtctggcctcaagtctgggaacacggcctcctgaccatctctgacttcagcctgagacgaggtnattactctgcagtcagattcagtaaacttccctcggttggtgttacggcgggagggaccagtcgctgaccgtcgtgagtcacgcccaaggccncggccccgtcggtccactctccgtttcccgccttcccg

SEQ ID NO: 358263 - DNA, 561 bp, Homo sapiens
  misc_feature: GZ8MTXP02JZXNJ.9.2.A02.1.454.CMB.2.raw
  modified_base (521)..(521): a, c, t, g, unknown or other
  misc_feature (521)..(521): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtgctctaatcatgtctcctggtactataacagtccaggcaaagcccccaaactcaataatttatgatgtctttagacggccctcagggtatttcttctcggttgtctggcctccaagtctggaacacggcctccctgaccatctctggacttcagcctgaggacgagggtgattacttctgctagttcagtacttcgaagtaaaccttccccgtaggtttgggtgtttccgggacgggtaggggacccagttcgctcgtaccgtcgtgacgtcacgcccaaggtcccncgcccccgtcggtcaccgtcctccgttcccacccttcccg

SEQ ID NO: 358264 - DNA, 562 bp, Homo sapiens
  misc_feature: GZ8MTXP02IEMLZ.9.2.A02.1.454.CMB.2.raw
  modified_base (435)..(435): a, c, t, g, unknown or other
  misc_feature (435)..(435): n is a, c, g, or t
tcagtgatacgtctcacgaccggtgctcgatttagactcatctacaggggggtctcaggaggcagcgctctcgggacgtctccaccatggcctgggctctgctattcctcaccctcctcactcagtgtacagggtcctgggcccagtccgccctgactcagcctgccgccgtgtctgggtctcctggacagtcgatcaccatctcctgcactggacccaccactgatattgggcattataaccttgtctcctggtatcaacacgcccagacaaagcccccacactcttaatttatgaggtcactaagcggcctcgaggggtttctggtcgcttctctgcctccaagtctggcaacacggcctcctgacaatctctgggctccagtctgacgacgagctgattattactgcagctcatatgctagtttggttcctntttacaagtattagttcggcgggacgggacccgagggcctacgggtacccgtcccgttggaacgttcgaacggccccgaaaacggggtccttaccggcccccccttcggggtaccaccgtttccccg

SEQ ID NO: 358265 - DNA, 636 bp, Homo sapiens
  misc_feature: GZ8MTXP02JQ3PQ.9.2.A02.1.454.CMB.2.raw
  modified_base (292)..(292): a, c, t, g, unknown or other
  misc_feature (292)..(292): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgcctgactcagcctgccgccgtgtccgggtctcctggacagtcgatcaccatctcgtgcactggaacgatagcgacattggtgctctaatcatgtctcctggtactataacagtccaggcaaagccccaaatcataatttangatgtctttagacggccctgagggtatttcttctcggttgtctggccctccaagtctagggaacacggcctcccgtgaccattcctctacgggacctttcgagtccctaggacgggacgaggggttgatttacttctgctagttcaagtatttcaacggtaaacctttccccgtagggttggggtcgtttccgggacggggtacggggtaccctagttcggccgttaggtaccccgttcgtaggaacgttaccgaacggacccccgaaacgggtcccgtaccggtccccccgttcgggttaccctaccgttccgtacccggtttcccccggacccctttccccg

SEQ ID NO: 358266 - DNA, 549 bp, Homo sapiens
  misc_feature: GZ8MTXP02F0ZNC.9.2.A02.1.454.CMB.2.raw
  modified_base (296)..(296): a, c, t, g, unknown or other
  misc_feature (296)..(296): n is a, c, g, or t
  modified_base (315)..(315): a, c, t, g, unknown or other
  misc_feature (315)..(315): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaaatcatgtctcctggtactataacagtccaggcaaagccccaaatcataatttangatgtctttagacggcctnagggatttcttctcgttgtctggcctccagtctggaacacggcctccctgaccatctctggacttcagcctgagacgaggtgattacttctgcagttcaagtacttcagtaaaccttccccgttaggttgggttcgtttccgggcgggacggggaccagtcggctggacccgtccgtgacgtcacgcccgaagccttacgcccccgtcggtcaccgtctcgttccccacctccc

SEQ ID NO: 358267 - DNA, 531 bp, Homo sapiens
  misc_feature: GZ8MTXP02JDM37.9.2.A02.1.454.CMB.2.raw
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
  modified_base (417)..(417): a, c, t, g, unknown or other
  misc_feature (417)..(417): n is a, c, g, or t
  modified_base (467)..(467): a, c, t, g, unknown or other
  misc_feature (467)..(467): n is a, c, g, or t
  modified_base (511)..(511): a, c, t, g, unknown or other
  misc_feature (511)..(511): n is a, c, g, or t
  modified_base (523)..(523): a, c, t, g, unknown or other
  misc_feature (523)..(523): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacaatagcgacattggtggctctaatcatgtctcctggtactatacagtcaggcaaagccccaaatcataatttangatgtctttagacggcctnagggtatttcttctcggtttgtctggcctccaagtctagggacacggcctccctgaccctatcctctcggacttcacgccctgaggacgagggtgtattacgttntgcagttcagattcagtaacttccctggttggtgttcggcggagggaccngtgctgaccgtctgacgtcacgccaacggctcgcccctcggtcnctcctcgtcccnccttcccg

SEQ ID NO: 358268 - DNA, 606 bp, Homo sapiens
  misc_feature: GZ8MTXP02GYL0L.9.2.A02.1.454.CMB.2.raw
  modified_base (236)..(236): a, c, t, g, unknown or other
  misc_feature (236)..(236): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacgaatagcgacattggnggctctaatcatgtctcctggtactataacagtccaggacaaacgacccccaaatccaataatttatgtattgtctttaacgacggtccctcgtagggtactttcttcgttcggttgtcgtggtccctaccgaaagttcgtacggggaacaccgggtccctcccgtcgaccctatcctcgtggtaccttcacgtctggacggacggagggtgtattacttctgctagttcagtattacacgtaacttccccgtgggttggtcgttcgggacggtaggtacctagtcgacgtcgaccgtcgtgtacgtcgacgtacccgacggtcctccgccccgtcggtacctaccgtcgttccgtccccgtccctcccg

SEQ ID NO: 358269 - DNA, 743 bp, Homo sapiens
  misc_feature: GZ8MTXP02IBSTK.9.2.A02.1.454.CMB.2.raw
  modified_base (238)..(238): a, c, t, g, unknown or other
  misc_feature (238)..(238): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacgaatagcgactagttgggnggctactaatcatgtctcctggtactataacagtccaggcaaacgcccccaaactcataattatgatgtcttagcgtcctgagggtatttctctcggttgtctggcctaccaagtcgtagggacaccggtcctccctgacctatctcgtggacttcacgtcctaggacgggacgtagggggtctaacttttaccgttcgtagccgttaagttccgtaaggtactttaccgtaaaaccgttaaaccccgtttccccccggttagggggtttccgggggttacggtttccgggggacggggtaaacgggggtaccccttaagtccgggtaccgttacgggtaacccggtttcccgttagggtaaaccggttcccgaaaacgggtccccccgaaaacggggtccccgtttaccccgggtaaccccccccggtttacccggggttcccgttaaccccctttcccggtttcccccggggtttcccccctaaccccccgttttacccccgg

SEQ ID NO: 358270 - DNA, 585 bp, Homo sapiens
  misc_feature: GZ8MTXP02GDHB5.9.2.A02.1.454.CMB.2.raw
  modified_base (234)..(234): a, c, t, g, unknown or other
  misc_feature (234)..(234): n is a, c, g, or t
  modified_base (296)..(296): a, c, t, g, unknown or other
  misc_feature (296)..(296): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggngctctaatcatgtctcctggtactataacagtccaggcaaacgcccccaaatcataatttangatgtcttagacgcctgaggtatttcttctcgttgtctggcctccaagtctgggaacacggcctccctgacctatctctggacttcagcctgaggacgagggtgattacttcgtgctagttcaggtacttacgaacgtaaccttccccttgggttggggtcgtttcgggacgggtaacggggacctagtcgtcgtcggtaacccggtctggtaacgtccgaacgacccgaacggcctcccggcccccgttcgggtccctacgttccgccgtttcccccaccctttcccg

SEQ ID NO: 358271 - DNA, 580 bp, Homo sapiens
  misc_feature: GZ8MTXP02I5F5G.9.2.A02.1.454.CMB.2.raw
  modified_base (336)..(336): a, c, t, g, unknown or other
  misc_feature (336)..(336): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacaatagcgacattggtggctctaatcatgtctcctggtactataacagtccaggcaaacgcccccaaatcataatttatgatgtctttagacggcctgagggtatttcttctcggttntctggcctccaagtcgtagggaacaccggtcctcccgtgacctatcctcgtggacttcacgcctggacgacggagggtgtattacttcgtgctagttcagtattcgaacgtaaaccttccccgttcggttgggtcggttcgggacgggtacgggacctagtgcgtcgtaccgtcgtgacgtcgacgccgaacggccgtccgcccccgtcggtacctaccgtcctccgttaccctacccttcccg

SEQ ID NO: 358272 - DNA, 577 bp, Homo sapiens
  misc_feature: GZ8MTXP02JLNRS.9.2.A02.1.454.CMB.2.raw
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (297)..(297): a, c, t, g, unknown or other
  misc_feature (297)..(297): n is a, c, g, or t
  modified_base (399)..(399): a, c, t, g, unknown or other
  misc_feature (399)..(399): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacgaatagcganattgggngctctaatcatgtctcctggtactataacagtccaggcaaacgccccaaatcataatttangatgtcttagacgcctcgagggtatttctctcggttgtctggcctccaagtctaggacacggcctcctgaccatctcgtgacttcagcctggagacgaggtnattactctgctagttcaagtattcgaagtaaaccttccccgttaggttcgggtcgttcgggacgggtagggaccctagttcgcgtcggtaccgtccgttaggacgtacgacgacccgaacggtcctccggcccccgtcggtcctaccgttccgttccgttccccctaacctttccccg

SEQ ID NO: 358273 - DNA, 571 bp, Homo sapiens
  misc_feature: GZ8MTXP02FSZZM.9.2.A02.1.454.CMB.2.raw
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (399)..(399): a, c, t, g, unknown or other
  misc_feature (399)..(399): n is a, c, g, or t
  modified_base (567)..(567): a, c, t, g, unknown or other
  misc_feature (567)..(567): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtgctctaatcatgtctctgtactatacagtccaggcaaagccccaaatcataatttangatgtnttagacgcctgagggtatttcttctcgttgtctggcctcaagtctagggacacggcctcctgacctagtcctactggacttcagcctagaggacgaggggtntattactcgtcgctagttcagtacttacgaacgttaaaccctttccccgttagggtttggggttaccgttcggggacgggtaacggggtaacctagtcgtcgtcggtaacccggtccttaggacgtcgacgccctaggcctcgccccgtcggtcacgtcgtcgtcccnctcc

SEQ ID NO: 358274 - DNA, 604 bp, Homo sapiens
  misc_feature: GZ8MTXP02JGX6O.9.2.A02.1.454.CMB.2.raw
  modified_base (296)..(296): a, c, t, g, unknown or other
  misc_feature (296)..(296): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctctggtactatacagtcaggcaaacgcccccaaactcataatttangtatgtactttagacggtcctcgagggtatttcttctcggttgtctggcctccgaagtctacgggaacacggcctcccgtgacctatctctggtacttcagctggaggaacggagggtgtattacttctgctagttcagtattacacgtaaccttccccgttagggttcgggttacggttcggggacgggtacgggaccgtagtcgtcgtacggtacccgttcgtggaaccgttcgacgtacccgaacggtcccgtccggcccccgttcggtctacgtttccgtccggtttaccccacccctttcccg

SEQ ID NO: 358275 - DNA, 697 bp, Homo sapiens
  misc_feature: GZ8MTXP02HZG6C.9.2.A02.1.454.CMB.2.raw
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (266)..(266): a, c, t, g, unknown or other
  misc_feature (266)..(266): n is a, c, g, or t
  modified_base (363)..(363): a, c, t, g, unknown or other
  misc_feature (363)..(363): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacagttggngctntaatcatgtctcctggtactataacngtccaggacaaacgcccccaaactcaattaatttatgatgtctttagacgcctgaggtatttctctcgttgtctgcctcctaaagtcgtagggaacncggccctcctacgacctactcctctcggactttccgagtccctggaacgggtaacggtaggggttgtaactttaccgtttcgtcggtacccttagttccgtaaagtacttttaaccgtaaacggttaaaaccccttttcccccggtttagggtttccgggggttcggtttaccgggggaccggggtaacgggggaacccctaaggtacggtccgttcggttaacccggtcccgtttaggacgttccgaaaacgtccccgaaaacgggtcccttccgccccccgtttagggtaccctaccttcccgttcccgtttaaccccctacccgttacccg

SEQ ID NO: 358276 - DNA, 657 bp, Homo sapiens
  misc_feature: GZ8MTXP02HT3ZI.9.2.A02.1.454.CMB.2.raw
  modified_base (236)..(236): a, c, t, g, unknown or other
  misc_feature (236)..(236): n is a, c, g, or t
  modified_base (300)..(300): a, c, t, g, unknown or other
  misc_feature (300)..(300): n is a, c, g, or t
  modified_base (428)..(428): a, c, t, g, unknown or other
  misc_feature (428)..(428): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacgaatagcgacagttggngctctaatcatgtctcctggtactataacagtccaggcaaacgcccccaaactcaataatttangtatgtctttagacggccctgagggtatttcttctcggtttgtctggcctccaagtctagggaacaccggcctccctgacctatcctctcggacttcacgcctgaggacgagggtagtagttaccttntggcagttcaagtattcaacggtaaaacctttcccccgttagggtttcggggttcggtttccggggacgggaacgggggtaccctaaggttcgtccgtacggtaacccggttccccgttggaaccgttcgtaaaccggaccccgtaaacgggcccgtttacccgccccccggttcgggttaaccctaccgttccgtttcccggtttcccccggtacccctttcccccgg

SEQ ID NO: 358277 - DNA, 557 bp, Homo sapiens
  misc_feature: GZ8MTXP02GE8K6.9.2.A02.1.454.CMB.2.raw
  modified_base (298)..(298): a, c, t, g, unknown or other
  misc_feature (298)..(298): n is a, c, g, or t
  modified_base (371)..(371): a, c, t, g, unknown or other
  misc_feature (371)..(371): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacgaatagcgacattggtgctctaatcatgtctcctggtactataacagtccaggcaaacgcccccaaatcaataatttangtatgtctttagacggccctcgagggtatttcttctcggttgtctggcctccaagtctggaacacggcctccngaccatctcgtcggacttcagtcctggaggacgagggtgtattactgtgctagtcagtattcgaagtaaccttccccgtaggttcgggtcgttcggcggtaagggccatcggctcgtaccgtcgtgacgtcgacgacccgaaggcctcgcccccgtgtaccacttccgtcgtaccccacccttccg

SEQ ID NO: 358278 - DNA, 589 bp, Homo sapiens
  misc_feature: GZ8MTXP02JCS2T.9.2.A02.1.454.CMB.2.raw
  modified_base (239)..(239): a, c, t, g, unknown or other
  misc_feature (239)..(239): n is a, c, g, or t
  modified_base (324)..(324): a, c, t, g, unknown or other
  misc_feature (324)..(324): n is a, c, g, or t
  modified_base (341)..(341): a, c, t, g, unknown or other
  misc_feature (341)..(341): n is a, c, g, or t
  modified_base (403)..(403): a, c, t, g, unknown or other
  misc_feature (403)..(403): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacgaatagcgaacagttgggnggctactaatcatgtctcctggtactataacagtccaggacaaacgcccccaaatcaattaatttatgatgtacttagacgcctnaggtatttctctcgttntctgcctcaagtctaggacacggcctcctgaccatctctggacttcagcctgagacgaggtnattctctgctagtcagtacttacgaagtaacccttccccgttaggtttcggggtcggttccgggcggtaacggggacctagtcgtcgttacgacccgttcgaggtacgtcgacggtacccgaacggtccctccggcccccgttacggtcctacccgttccgtccccgttttacccccccactaccg

SEQ ID NO: 358279 - DNA, 570 bp, Homo sapiens
  misc_feature: GZ8MTXP02GYKNT.9.2.A02.1.454.CMB.2.raw
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacgaatagcgacattggtggctctaatcatgtctcctggtactataacagtccaggcaaacgcccccaaactcataatttatgatgtctttagacgccctcagggtatttcttctcgttgtctggcctcaagtctagggaacaccggcctcccctgaccattcctcgtggtacttcagccctaggacggtacgagggtgtattacttctgcagttcagattcaacgtaaaccttcccgtggttgggtcgttcgggcgggagggaccagtcgtctcgaccgtctagacgtccgacgacccaaggtcctaccggcccccgtcggtcctaccgtctccgttcccctacccttcccg

SEQ ID NO: 358280 - DNA, 720 bp, Homo sapiens
  misc_feature: GZ8MTXP02JVY2N.9.2.A02.1.454.CMB.2.raw
  modified_base (241)..(241): a, c, t, g, unknown or other
  misc_feature (241)..(241): n is a, c, g, or t
tcagtgatacgtctcacgaccggtgctcgatttagactcatctacgaggggggggtctcaggaggcagcgctctcgggacgtctccaccatggcctgggctctgctattcctcaccctcctcactcagtgtacagggtcctgggcccagtccgcctgactcagcctgccgccgtgtccgggtctccgtggacaggtcgatcaccatctcgtgcactggaacaatgcgacagttgggtgctntaatcatgtctctgtactatacagtcaggacaacgccccaaactcaattaatttatgtattcgttactttaagaccggtcccctagtagggttacttttcgtttcgttcgggttttgtccgttggcccttaccgtaagtcgtacggggaactaccggcccttcccgtacgactacttctcgttcggaccttacacgtccgtggaacgggacggaggggttctaagtttaccgttacgttaggtaccgtacggtttaccaaggttactttaacgaacccgttaaaaccctttcccccgggttagggttttcgggtccggtttacgggggaccgggtaagggaccccgtaggttaccgtcgttccggaaccggtttcccgaggtaccgttaccggacgtacccgggaaccggtcccgtccggtcccccgttccgggtaccttacccgttccggttcccgttaaccccctaccccgttcccg

SEQ ID NO: 358281 - DNA, 588 bp, Homo sapiens
  misc_feature: GZ8MTXP02JPAPL.9.2.A02.1.454.CMB.2.raw
  modified_base (264)..(264): a, c, t, g, unknown or other
  misc_feature (264)..(264): n is a, c, g, or t
  modified_base (314)..(314): a, c, t, g, unknown or other
  misc_feature (314)..(314): n is a, c, g, or t
  modified_base (320)..(320): a, c, t, g, unknown or other
  misc_feature (320)..(320): n is a, c, g, or t
  modified_base (396)..(396): a, c, t, g, unknown or other
  misc_feature (396)..(396): n is a, c, g, or t
tcagtgatacgtctcacgaccggtgctcgatttagactcatctacaggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacngtccaggcaaagccccaaactcataatttatgatgtctttagacgccctnagggtntttcttctcggttgtctggcctccaagtctgggacacggcctcctgaccatctctggacttcagcctagaggacgnggtgattactctgctagttcagtatttcagtaaacctttccccgtcgggtttggggtcgtttccggggcggggtaacgggtacctagttcggcgttacggaccccgttcgttggacgttaccgacggacccgaaacgggcctacggcccccgtcgggtcccacgttccgtccggttcccccgtcccttcccg

SEQ ID NO: 358282 - DNA, 801 bp, Homo sapiens
  misc_feature: GZ8MTXP02JO3KS.9.2.A02.1.454.CMB.2.raw
  modified_base (306)..(306): a, c, t, g, unknown or other
  misc_feature (306)..(306): n is a, c, g, or t
  modified_base (333)..(333): a, c, t, g, unknown or other
  misc_feature (333)..(333): n is a, c, g, or t
  modified_base (370)..(370): a, c, t, g, unknown or other
  misc_feature (370)..(370): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctccgtggacagtcgatcaccatctcgtgcacgtggaaacgaatagcgacagttgggtgctactaatcatcgtctctggtactataacagtccaggacaaacgcccccaaactcaattaatttangattgtactttagacggcctgagggtntttcttcgtcggttgtcgtgcctcagtcgtagggacnccggcctcctgaccactctcgtcggtaccttcgacgtccgtaggaacgggtaccggtaggggttacgtaacgttttaaccgttcgttacggtaccgttaaggtttacccgtaaagttaaccgtttaccgaaaaccggtttaaacccccgtttttccccccggtttgggggttttaccgggggtttcgggtttacccgggggtaccgggggtaaacggggtaaccccgtaacggtttaccggggtcccgtttaccggggtaacccccggtttcggttaaccgggtaaccgggtttacccgaaaccggggtaccccccggtaaacggggttcccccgttacccccggggttcccccccgttcgggggttaacccccttaccccgtttcccggtttacccccggtttcccccccgtaccccgtttaccccccgg

SEQ ID NO: 358283 - DNA, 596 bp, Homo sapiens
  misc_feature: GZ8MTXP02F78I8.9.2.A02.1.454.CMB.2.raw
  modified_base (233)..(233): a, c, t, g, unknown or other
  misc_feature (233)..(233): n is a, c, g, or t
  modified_base (297)..(297): a, c, t, g, unknown or other
  misc_feature (297)..(297): n is a, c, g, or t
  modified_base (314)..(314): a, c, t, g, unknown or other
  misc_feature (314)..(314): n is a, c, g, or t
  modified_base (333)..(333): a, c, t, g, unknown or other
  misc_feature (333)..(333): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacaatagcgacattggngctctaatcatgtctcctggtactataacagtccaggacaaacgcccccaaatcaataatttangatgtcttagacgcctnagggtatttcttctcggtntctggcctcaagtctagggaacacggcctcctgacctattcctcgtggacttcagcctggaggacgtagggtgtattacttcgtgctagttcaagtattacgaacgtaaacctttccccgttagggttcgggtcgttacgggacgggtacggggtaacccagtcggtccgtacggtacccgttccgtaggacgtaccgacgacccgaacggccctccgcccccgtggtacctaccgtccgtacgttaccccctacccttaccc

SEQ ID NO: 358284 - DNA, 601 bp, Homo sapiens
  misc_feature: GZ8MTXP02GBPHO.9.2.A02.1.454.CMB.2.raw
  modified_base (295)..(295): a, c, t, g, unknown or other
  misc_feature (295)..(295): n is a, c, g, or t
  modified_base (418)..(418): a, c, t, g, unknown or other
  misc_feature (418)..(418): n is a, c, g, or t
  modified_base (432)..(432): a, c, t, g, unknown or other
  misc_feature (432)..(432): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctctggtactataacagtccaggcaaacgccccaaatcataatttangatgtcttagacggtccctgagggtatttcttcgtcggtttgtctcggcccttaccgaagttcgtaggggaacctaccgggccctcccgtgacctatccgtctggacttcagcctgaggacgngggtgtattacttnagtctagttcagtattacacggttaaccttccccgttgggttacgggtcgttcgggcggtagggacccagtcgcgtcgtaccgtcgtaggtcgtacgacgtcccgaacggtccgtcccgcccccgttacgggtcctaccttccgttacccgttacccccacccttcccg

SEQ ID NO: 358285 - DNA, 658 bp, Homo sapiens
  misc_feature: GZ8MTXP02I12AO.9.2.A02.1.454.CMB.2.raw
  modified_base (300)..(300): a, c, t, g, unknown or other
  misc_feature (300)..(300): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcacatctcgtgcacgtggaacgaatagcgacagttggtggctctaatcatgtctctggtactataacagtcaggacaaacgcccccaaatcaattaatttangtatgttactttagaccgtcctgtagggtattttcttcgttcggttgtacgtcggtccctaccgtaagtcgtacgggaaccaccggtccctccctagaccacttcctcgtggtaccttcgacgccgtaggaggacggtagggttagtattacttcgtcgtacgtacgttactaggttacttacgaacgttaaacctttccccggttcgggtttaggggttcggttaccggggtacggggacggaacgtgtacgtcgtacggtaccgttccgtaggtacgtaccgaccgcccgaacggtccgtcccggtcccccgtcggtacctccgttccgttcccggttccccgtcccgttaccccg

SEQ ID NO: 358286 - DNA, 582 bp, Homo sapiens
  misc_feature: GZ8MTXP02G9GUK.9.2.A02.1.454.CMB.2.raw
  modified_base (235)..(235): a, c, t, g, unknown or other
  misc_feature (235)..(235): n is a, c, g, or t
  modified_base (300)..(300): a, c, t, g, unknown or other
  misc_feature (300)..(300): n is a, c, g, or t
  modified_base (441)..(441): a, c, t, g, unknown or other
  misc_feature (441)..(441): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacaatagcgacagttggngctctaatcatgtctcctggtactataacagtccaggacaaacgacccccaaatcaattaattangtatgtacttagacgcctgagggtatttcttcgtcgttgtctggccctaccgaagttcgtagggaacaccggtccctcccgtagacctatctctgtacttcagcctaggaggacggaggtgtattactctgctagtcagtnttacaacgtaacctcccgttggttagggtgttcgggcggacggcctagtcgtacgtcgtacccgtcgtgtacgtcgacgacccgacgccgtccgtccccgtacggtcccaccgttcccttcccgttccccctacgtacccg

SEQ ID NO: 358287 - DNA, 662 bp, Homo sapiens
  misc_feature: GZ8MTXP02HZZI7.9.2.A02.1.454.CMB.2.raw
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (302)..(302): a, c, t, g, unknown or other
  misc_feature (302)..(302): n is a, c, g, or t
  modified_base (332)..(332): a, c, t, g, unknown or other
  misc_feature (332)..(332): n is a, c, g, or t
  modified_base (370)..(370): a, c, t, g, unknown or other
  misc_feature (370)..(370): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacaatagcganagttggngctctaatcatcgtctcctggtactataacagtccaggacaaacgccccaaactcaattaatttangtatgttacttagaccggtcctgagggttntttctgtcggtttgtcgtggcctcgaagtcgaggaacnccggcctcctgaccattctctcggacttcgacgcctggacggacggtaggtagtattacgtctagactagtcagtacttacgaacgttaaaccgttcccgttacgggttcggggttggttacccgggtacggggtaaccgggtaacgtacgtcggtaccgttacggtaccccggttacgttacggtacgttacggaccggtaccccgaaacggtcccgtaccccggtcccccggttacggtacccgttacccgttcccgtttcccggtttccccgtaccccggtttaccccg

SEQ ID NO: 358288 - DNA, 647 bp, Homo sapiens
  misc_feature: GZ8MTXP02I2DNI.9.2.A02.1.454.CMB.2.raw
  modified_base (302)..(302): a, c, t, g, unknown or other
  misc_feature (302)..(302): n is a, c, g, or t
  modified_base (388)..(388): a, c, t, g, unknown or other
  misc_feature (388)..(388): n is a, c, g, or t
  modified_base (421)..(421): a, c, t, g, unknown or other
  misc_feature (421)..(421): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctccgtggacagtcgatcaccatctcgtgcactggaaacgaatagcgaacagttggtgctctaatcatgtctccgtggtactataacagtccaggacaaacgcccccaaatcataatttangatgtcttagacgtcctgaggtatttcttctcggtttgtcgtggccctaccgaagtcgtagggaacaccggtccctcctgaacctntctcgtggacttcacgctggaggacgtagggtntaagttacttctgactagttctagtacttacgaacgttaaacctttcccccgttagggtttcgggtacgggttcgggtacgggtacgggtaacctagtcgtcgttccggtacccggttccgttcggtaaacgttccgaaccggtaccccgaaacggtcccgtacccggtcccccgttcggtaccttacccgttccgtttcccggttaccccctacccctttacccg

SEQ ID NO: 358289 - DNA, 691 bp, Homo sapiens
  misc_feature: GZ8MTXP02HO5R0.9.2.A02.1.454.CMB.2.raw
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtgctctaatcatgtctctggtactatacagtccaggaccaagcccccaaatcattaatttatgatgtctttaggacggcccctacgagggtattttcttcgttcggtttgtcgtcggtcccctaccgtaaaggttcctacggggaaaccacccggggtcccttcccccgtggtaaccctattcccttcgtacgggtacctttcgacgtccctaggaacgggacggaggggttgtacgtttacctttacgtcgtcgtaggtttccaaggtactttacaacgttaaaacccgtttccccgtttaccgggtttcggggttcggtttcgggggaccggggtaacgggtaccgtaagtcggtcgtaccggtaccgttccgttaggtaccgtcggaccgacccgaacgggtcccttccggtcccccgtcggtcctacctcgtcccttccccgtacccttcccg

SEQ ID NO: 358290 - DNA, 728 bp, Homo sapiens
  misc_feature: GZ8MTXP02HN50B.9.2.A02.1.454.CMB.2.raw
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcacgtggaaacgaatagcgacagttgggtggctactaatcatcgtctctggtactataacagtccaggacaaacgcccccaaactcaattaatttatagtatgttactttacgacggtccctcgagggttctttctttcgtcggtttgtcgttcggcccttaccgtaagttcgtacggggaacaccggtccctcccgtcgacctatcctcgtggaccttcgacgtccgtggacgggtacggtaggggttagtagtttaccttcgtcgtacgtagtttcgaagtactttaccgtaaacgtttaaacccgtttcccccggtttcggggtttacggggttcggttccggggtaccggggtaacggggtacccttaaggtccggtacgtaccggtaacccgttccggttacggtacggttaccgaaccggtaccccggaaccggggtccctccccggtccccccgttccggtcccgttacccgttccgttaccccgtttcccccctaacccccgtttccccg

SEQ ID NO: 358291 - DNA, 629 bp, Homo sapiens
  misc_feature: GZ8MTXP02FMNNB.9.2.A02.1.454.CMB.2.raw
  modified_base (238)..(238): a, c, t, g, unknown or other
  misc_feature (238)..(238): n is a, c, g, or t
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
  modified_base (315)..(315): a, c, t, g, unknown or other
  misc_feature (315)..(315): n is a, c, g, or t
  modified_base (365)..(365): a, c, t, g, unknown or other
  misc_feature (365)..(365): n is a, c, g, or t
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
tcagtgatacgtctcacgaccggtgctcgatttagactcatctacgaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatccaccatctcgtgcactggaaacgaatgcgacagttggngctntaatcatgtctcctggtactataacagtcaggcaaacgccccaaatcataatttangatgtcttagacgcctnagggtatttcgttctcggtgtctggcctcaagtctggaacacggcctccngaccatctctggacttcagcctaggagacggtaggtntattacgttntgctagttcgaagtacttacgaacgtaaacccgtttcccccgttagggttcgggttcggttaccggggacggggtacgggtaaccctaggtacggtccgtaacggtacccgttcgtaggtacgttaccgacgacccgtaacggtccctacccggtcccccgttccggtaccttacccggttcccgttacccgtttacccccgacccctttaccccgg

SEQ ID NO: 358292 - DNA, 681 bp, Homo sapiens
  misc_feature: GZ8MTXP02JEQ2M.9.2.A02.1.454.CMB.2.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (261)..(261): a, c, t, g, unknown or other
  misc_feature (261)..(261): n is a, c, g, or t
  modified_base (355)..(355): a, c, t, g, unknown or other
  misc_feature (355)..(355): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgcctgactcagcctgccgcgtgtccgggtctcctggacagtcgatcaccatctcgtgcacgtggaacgaatagcganagttggtgctntaatcatcgtctctggtactanaacagtcaggacaaacgacccccaaactctaattaatttatgtaatcgttactttacggaccggtcctacgtagggtactttcttcgtcggttntcgtgtccctccgtaagtcgagggtacgaccgccctcccgtgacctacttctcgtcggtacttcgacgtccgtggaacgggtacgggtagggttgtaactttcgttctcgtacgtacgttcgaaggttacttacgtaacgttaaacccgtttccccgttcggggtttacgggtcgggttccgggtacggggaccggggtactaggtcgtaccggtacgtacccggtcggtaccggtaacgttccgaaccggacccgtaacgggtcccgtccccggtccccggtcggtccctaccgttccgtttcccttccccggtaccctttcccg

SEQ ID NO: 358293 - DNA, 644 bp, Homo sapiens
  misc_feature: GZ8MTXP02ICDYX.9.2.A02.1.454.CMB.2.raw
  modified_base (161)..(161): a, c, t, g, unknown or other
  misc_feature (161)..(161): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactnagcctgccgccgtgtccgggtctcctggacagtcgatcaccatctcgtgcacgtggaaacgaatgcgactagttgggtgctataatcatcgtctctggtatataacagtccaggacaaacgacccccaaatcaattaatttatgtattgtactttaggccggtcctagagggtacttttctcgttcggttgtcgtggtccctaccgtaagtcgtacgggaacctaccggccccttcctacgaccacgttccttcgtacgggtactttacgcccgttaggaggtacggtaggtacgtatttacgtcgtacggactacggttacagtacttacgtaaaccgtaacctttccccgttagggttcgggtcggttccgggaggtacgggcctagtcgtacgtccgaaccgttcgagtcggcaacggccctaagccctccggtccccgtaacggtcctccgttccgtccggtccccctcctaacgtccg

SEQ ID NO: 358294 - DNA, 732 bp, Homo sapiens
  misc_feature: GZ8MTXP02GRRZL.9.2.A02.1.454.CMB.2.raw
  modified_base (299)..(299): a, c, t, g, unknown or other
  misc_feature (299)..(299): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctgtgcactggaacgaatagcgactagttggtgctactaatcatgtctctggtactatacagtccaggacaaacgaccccaaatcaataatttanagatgtctttagaccgtcctgtagggtatttcgttcgttcggttgtcgttggcccttaccgagttcgtacggggtaaccacccgggtcccttccccgtacggtaaccctacgttccgttaccgttacgggtaacctttccgaaacgtcccgttagggaacgggaacggtaacggggttagttaacttttaacccgttcgtcggtaaccgtaggtttacctaaaggttaactttaacgtaaaccgttaaacccgtttcccccggttaggggtttcggggttcggtttaccgggggaccgggtaacggggtaaccctagggtccgtacgttacggtaacccgttcgtaggtaccggtacgaacgtaccccggaacgtccgtcccgtccccggtacgtacctaccggtccctttccggttccccgtacccctttcg

SEQ ID NO: 358295 - DNA, 696 bp, Homo sapiens
  misc_feature: GZ8MTXP02IA68G.9.2.A02.1.454.CMB.2.raw
  modified_base (265)..(265): a, c, t, g, unknown or other
  misc_feature (265)..(265): n is a, c, g, or t
  modified_base (298)..(298): a, c, t, g, unknown or other
  misc_feature (298)..(298): n is a, c, g, or t
  modified_base (323)..(323): a, c, t, g, unknown or other
  misc_feature (323)..(323): n is a, c, g, or t
  modified_base (365)..(365): a, c, t, g, unknown or other
  misc_feature (365)..(365): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacaatagcgacagttggtgctataatcatcgtctcctgtactataacngtccaggcaaacgcccccaaatcaataatttangtatgtacttagaccgcctgaggtntttctcgtcggttgtctggtccctacgagttcgtaggaaccnccggccctcctagaccctattccttcgtagccttcacgtcgaggaggacggtagggtgtaagtttcccttagtcgtaccgtagttacaaagttacgtttacgaacggttaaacccctttcccccggttagggtttggggtccggtttacggggacgggggtaacggtaccctaggttccgtacgtaccgggtacccgttacccggtggtaaccggttaccgaaccgggtacccccgtaacgggtccccgttccccggcccccccggttacgggttacccctacccgtttaccggttcccccgtttacccccgtaaccccctttacccccgg

SEQ ID NO: 358296 - DNA, 610 bp, Homo sapiens
  misc_feature: GZ8MTXP02FZPII.9.2.A02.1.454.CMB.2.raw
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
  modified_base (297)..(297): a, c, t, g, unknown or other
  misc_feature (297)..(297): n is a, c, g, or t
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtncactggaacgaatgcganagttggngctctaatcatgtctcctgtactataacagtccaggacaaacgcccccaaatcaataatttangatgtctttagaccggcctcgagggtatttcttcgtcggttgtctggcctccgaagtctaggacacgtcctccncgaccactctcgtcgacgttccncgcgtcggaggacggtaggtacgtagttacttcgtcgtcgtagtactaagtactaacgtaacgtaacccgttacccgttcggtttaggttcgggtcgggtacggacggacgtacgtcgtcgtccgtacgtcgtacgtacgtaccgacggacccgtaacggtcctcccggtcccgttccgtactacccgtccgttcccgtaccccctacccgtcccg

SEQ ID NO: 358297 - DNA, 644 bp, Homo sapiens
  misc_feature: GZ8MTXP02JT4NJ.9.2.A02.1.454.CMB.2.raw
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (390)..(390): a, c, t, g, unknown or other
  misc_feature (390)..(390): n is a, c, g, or t
  modified_base (575)..(575): a, c, t, g, unknown or other
  misc_feature (575)..(575): n is a, c, g, or t
  modified_base (581)..(581): a, c, t, g, unknown or other
  misc_feature (581)..(581): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgcccgcgtgtccgggtctcctggacagtcgatcaccatctcgtgcactggaaacaatagcgactagttggtgctactaatcatntctcgtgtactanaacngtccaggacaaacgccccaaatctaattaatttatgtattcgttacttacggaccgtcctgtagggtactttcttcgttacggttgtccgtaggtcccctactaacggtcgtacgggaaaccnccggtccctcccgtacgacctacttccgtacgtcggtaccttcgacgtcccgtaggtaacggggtaccggtagggggttatactttacgtcgtcgacttacgtatacggtactttacgaaccgttaaccttccccggtgggttcggtacggttcggacgggtggactggtcgctcggtaccgtgngtacgngacccgtacgacgtccgtccgtccccgtcgtacctcgtcctacccgttcccgtaacccttccg

SEQ ID NO: 358298 - DNA, 679 bp, Homo sapiens
  misc_feature: GZ8MTXP02GK0FT.9.2.A02.1.454.CMB.2.raw
  modified_base (235)..(235): a, c, t, g, unknown or other
  misc_feature (235)..(235): n is a, c, g, or t
  modified_base (296)..(296): a, c, t, g, unknown or other
  misc_feature (296)..(296): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggnggctctaatcatgtctcctggtactataacagtccaggcaagcccccaaatcataatttangatgtctttagacgcctcagggtatttcttcgtcgttgtctcggtcctccaagtctgggacaccggctcctgacctatctctggacttcacgcctagacgggacggacgggttagtagttaccttctggactaggtttcaaaggttacttacgaacggtaaaaccctttccccggttacgggtttcgggggttgtttccgggggacgggtaacggggaccctagttcggtacccgtcggtaaccccggttccgtagggtaaaccgtccggttaaccgtacccccgaaacgggggtcccttaacccggggtccccccccgttcggggttacccttccccggttaaccgttccccggttttaaccccccgaccccctttccccgg

SEQ ID NO: 358299 - DNA, 555 bp, Homo sapiens
  misc_feature: GZ8MTXP01C2FFE.10.39.D06.1.454.CMB.2.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccaccctcggtgtcagtcggccccaggacagacggccacgctgacctggtgggggatacacaattggaaagtaatcgtgtgcacgtggtaccagcagacggccaggccacggccctggtggttgtcgtctataatgataacgacccgcctcgagggactccgtgacgccgtacttctcgtcggtcctaacccgaagttccggggacaaaccgaccgggacccaccctcactcactcgaccgagggtcgagggccggggatcggacggccgactactactgtcgtaggggtgtgggtatttcgactacgtgatcgagtggtgggggtcttgggcggaggacacgcgtacgcgttacgttgcaacgccaagctcgccctcgctccg

SEQ ID NO: 358300 - DNA, 570 bp, Homo sapiens
  misc_feature: GZ8MTXP01EL0FL.10.39.D06.1.454.CMB.2.raw
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
tcagcatagtagtgcacgaccggtgctcgatttagtgacatctcgcagttctttgggctgacttaggacggtcagcttggtgcctcacgccatggcctggaccgttctcctcctcggcctcctctctcactgcacagactctgtgacctcctatgcgctgactcagccaccctcggtgtcagtcggccccaggacagacggccacgctgacctgtgggggatacacaattggaagtaatcgtgtgcactggtaccagcagagcaggccaggcccctgtggtntcgtntataatgataacgaccggcctcgagggactccctgagcgattcctcgtggctcccaaagttccggggacaacgccggaccaccctcatcatcaccgagggtcgagggccggggagtggacggccgacgtactacgtcgctagggtggtggggggtacttttcgactactagatcgtagtgggtgggggtcttggggcggaggggaacctaaaggcgtcgttaccgtacgtaaggttcacgacccgaagggctccgcccccgttcggcctccgttccgttcccg

SEQ ID NO: 358301 - DNA, 669 bp, Homo sapiens
  misc_feature: GZ8MTXP01ENRME.10.39.D06.1.454.CMB.2.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacgccacgctgacctgtggggatacacaattggaagtaatcgtgtgcacgtggtaccagcagaggccaggccacggcccctgtggttgtcgtctataatgataacgacccggccctcgagggactcccgtgacgccgatttctcgtcggcctaacccgtaaagttccgggggaccaaaccgacccgggacccctaccccttacacttccaacttccgaaacccgtagggggtccgaacggggcccgggggtaagttcgggaacgggcccgtaaacgtaccgtaacgttgtaccgtaagggggttggttacggggtactttacgaacgttaactggtaacttcgagttggggttcgggggttccttcggggcggggtaacgggaaccgaaacggttcgtacggtaacccgttaccgttaagttccgaacggcccgaacggtcctcggccccctcgggttccctaacccg

SEQ ID NO: 358302 - DNA, 551 bp, Homo sapiens
  misc_feature: GZ8MTXP01BIVO5.10.39.D06.1.454.CMB.2.raw
  modified_base (310)..(310): a, c, t, g, unknown or other
  misc_feature (310)..(310): n is a, c, g, or t
tcagcatagtagtgcacgaccggtgctcgatttagtgacatctcgcagttctttgggctgacttaggacggtcagctggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctnagggatccctgagcgattcctctggctccaattcgggcaacacgcccacctcatcatcaccagggtcagggccggggatgaggcgacgactactgtcgagtgtgggggtaggttcgtactactacgtagtcgtagtggtcggggtcggtcgggtcgggacgggaacgaacgacgtcgaccgtaccgtacgttacgcgaccgaacgccgtccgtccccgtccgttaccgtccgttccgtccg

SEQ ID NO: 358303 - DNA, 654 bp, Homo sapiens
  misc_feature: GZ8MTXP01CG6VI.10.39.D06.1.454.CMB.2.raw
  modified_base (326)..(326): a, c, t, g, unknown or other
  misc_feature (326)..(326): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccaccctcggtgtcagtcggccccaggacagacggccacgctgaccgtggtggggatacactaagttggaagtaatcgtgtgcacgtggtaccagcagacggccgaggccacggcccctggtggttgtcgtctataatgataaccgaccgcccngaggactccgtagacgtccgtattctcgtacggcctaaccgtaagttccgggacaaaccgaccggccacccctcactcacgtacgaccggtaggggtcggacggggtaccgggacgtacgggaccgggtaccgtaacgttaccgtaacgtcgtacggtaggggggttggtacggggttactttaccgtaacgtacgtgtaagtcgtagttcggggtcgggggttcgttccggggaacggggtacggaccgaacggttcgtacggtaccgttaccgacgttcgaaccgacccgtaacggcccgttccggccccgtcggttcctaacccg

SEQ ID NO: 358304 - DNA, 657 bp, Homo sapiens
  misc_feature: GZ8MTXP01C1G95.10.39.D06.1.454.CMB.2.raw
  modified_base (508)..(508): a, c, t, g, unknown or other
  misc_feature (508)..(508): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccaccctcggtgtcagtcggccccaggacagaccggccacgctgaccgtggtgggggatacactaattggaagtaatcgtgtgcacgtggtaccagcaggacggccacggccacggtcccctggtggttgtcgtctatatcgactaacgacccggtccctagaggtactccgtgacgccgtattctcgtcggcctaccgaagttccgggaccaaacgccgggcccaccctcactcacgtaccaccggaggggtcgacggggcccggggatcgggacgcccggaacttacgtcgtagtcggaagggggttggtacggggtactttacggacttaacgngtacttacgaggttgggggttcggggttcggttcgggggaacgggaacgggaaccgtaacggttcgtaaccggtaccgttaccgttaacgttaccgaaccggtacccgaacggtcccgtccggttacccccgttgggaaccctttcccg

SEQ ID NO: 358305 - DNA, 822 bp, Homo sapiens
  misc_feature: GZ8MTXP01BW4MR.10.39.D06.1.454.CMB.2.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgcccacccgtcggtgtcaggtccggcccaggacacggaccggccacgctgaccgtgggtaggggactacaacgtaagttaggaagttaacgttcggtgtcgactacgtcggtaccgagacgaggacggaccgacgggcccgaccgggtccccgttggttcggttcgtccgttactaagtaaacgtagtaacgtaaccggaccccgggtccctacggacggtacctcccgagacgtccgtacttcgtcgtcggtcctaaaccgtaacgttccgggactaaaccggcccggaccctacccgtacactaccacgtaccgaaccgggtacgggtccgggaaaccggggcgggtaacgtacgggaccggtacccgtaacgttacgtacgtacgggttaccggtaagggggtttcggggttaacgggttacctttacgtaaccgttacgtggtacttaccgggttaggttcgggggttacgggggttccggttcgggggaacggggtaaccgggttaaacccgtacgggttaccggttaaacccggtcccggtttaacccgttacggttaacccggaacccggttaacccccgggaaacgggttcccccgtccccgggttacccccggttccccgggttaacccgtttaacccccgg

SEQ ID NO: 358306 - DNA, 722 bp, Homo sapiens
  misc_feature: GZ8MTXP01AOVTX.10.39.D06.1.454.CMB.2.raw
  modified_base (585)..(585): a, c, t, g, unknown or other
  misc_feature (585)..(585): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccaccgtcggtgtcgaggtccggacccgaggacacggaccggccacgcgtcgaccgtgggtagggggatacgaactaagttggaaagtaatcgtagtcgctacgtcggtaccagacgaggacggaccgacggccgaccggtccccgttggtcggttcgtacgtactaagtaacgtagtaacgtaacccggacccggtaccctacggacgggtacctccgtagacgtcccgtattcgtccgtcggtccttaaaccgtaacgttccgggacctaaaccgacccggacccctacctacgtactaccgtactccggaaccggtaggggacgacgggggcggacgtacggaccggtaccgtaacgttactacggtggtaccgtagggggttcggtacggttattacccgaagttacgngttaactcggtgttggggtccggggtttcgcggggaacgggaacggttaccgtaacggcgtaccggtaacccgttagacggttcccaacgggacccgtaacggtccccgtcccggttcccgtaacggttcctccccg

SEQ ID NO: 358307 - DNA, 651 bp, Homo sapiens
  misc_feature: GZ8MTXP01AKIUY.10.39.D06.1.454.CMB.2.raw
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (262)..(262): a, c, t, g, unknown or other
  misc_feature (262)..(262): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (317)..(317): a, c, t, g, unknown or other
  misc_feature (317)..(317): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagcctctgcgacctcctatgtgctgtctcacgcccaccctcggtgtcagtcggccccaggagagacggcaggataaccgnggtggggganacagcatagaagtgagctgcagngtacngnagngcngcngcctgactgtcctntatnatgatagtcgaccggcctgacgggctcccgngacggcgtacttctcgtcggtcctaaccgaaccgtcgtacgggaaccacccggtacccacccgtacgacccaacgtccgaacccggtaggggtaccgaaagggtccccggggggatacgggacgggtaccctaaacgttagtttacggtcggtaccgtagggggttcgtttgggtaacttttcgaaggttagtttcgttaacgggtcgggttttacccgggggggtttcgaaccgggggtaagggaacctaaacggttccgtacggttaccccgtgtacggttcgaccggacccgtaacgcgtccgtcccccgtagcctaaccgttccgtcccg

SEQ ID NO: 358308 - DNA, 520 bp, Homo sapiens
  misc_feature: GZ8MTXP02JGEBG.10.39.D06.1.454.CMB.2.raw
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
  modified_base (434)..(434): a, c, t, g, unknown or other
  misc_feature (434)..(434): n is a, c, g, or t
tcagcatagtagtgcacgaccggtgctcgatttagtgacatctcgcagttctttgggctgacttaggacggtcagctggtgcctcagccatggcctggaccgttctcctcctcggcctcctctctcactgcacagactctgtgacctcctatgcgctgactcagccaccctcggtgtcagtggccccaggacagacggccacgctgacctgtgggggatacgacaattggaagtaatcgtgtgcactggtaccagcagagccaggccaggcccctgtggttgtcgtctataatgataacgaccggccctcagggatccctgagcgattcctctggctcattcgggcacgacgccaccctnatcatcaccgnggtcgaggccgggatggagccgactacgtactgtcgaggtgtgggtacttcactactgaactnagtggtgggtcgtggacggacggacgagcgtacgaccgtactacgcacgaccgaacgccgtcgccccgtcgtcctacgtccgtccg

SEQ ID NO: 358309 - DNA, 576 bp, Homo sapiens
  misc_feature: GZ8MTXP02G7UZT.10.39.D06.1.454.CMB.2.raw
  modified_base (327)..(327): a, c, t, g, unknown or other
  misc_feature (327)..(327): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggcctcgagggactcccngagccgtattctctggcctaccaagttccggggcaaacgaccggcccaccctcactccactccacccgaggggtcgagggcccgggggatcggacggcccgactacgtacgtgtcgaggtcgtgggtatttcgactacgtgactcgagttggtcgggggtcttcggggcggagggaccaaggtcgtacgaccgtaccgtaagtcgaacggtacccgaacggtcctaccgtcccccgtcggtacctaccg

SEQ ID NO: 358310 - DNA, 518 bp, Homo sapiens
  misc_feature: GZ8MTXP02I3GLT.10.39.D06.1.454.CMB.2.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggtgtcgtctataatgataacgacccgggcctcagggatccctgagccgattctctggctccaattcggggcaaacgacggcccacccgtcactcactcaccgagggtcgaggcccggggatcggaggccgatactctgtcaggtgtgggtatttcactactgatcagtgtggggtcttggcggtaggaccagctcgacgtactagtcaagccctaaggctcgccctcggtctac

SEQ ID NO: 358311 - DNA, 571 bp, Homo sapiens
  misc_feature: GZ8MTXP02H1CYV.10.39.D06.1.454.CMB.2.raw
  modified_base (416)..(416): a, c, t, g, unknown or other
  misc_feature (416)..(416): n is a, c, g, or t
tcagcatagtagtgcacgaccggtgctcgatttagtgacatctcgcagttctttgggctgacttaggacggtcagcttggtgcctcagccatggcctggaccgttctccgtcctcggcctcctcctctcactgcacagactctgtgacctcctatgcgctgactcagccaccctcggtgtcagtggccccaggacagacggccacgctgacctggtgggggatacgacaattggaagtaatcgtgtgcactggtaccagcagaggccaggccacggcccctgtggttgtcgtctataatgataacgaccggccctacagggactccctgacgcgtattcctctcggtctccgtaagttccggggcaccgaccgggcccacccctcaatcatccaccgagggtcgacggccgggganggacggccgactactacgtgtcgaggtgttagggtattttcatacgtgtatgtagtggtggggtcggtcgggtacgggacgggacgacgacgtacgtaccgtacgtacgtacgacgaccgaacgccgccgtcccgtccgtccgtccgtccgtccg

SEQ ID NO: 358312 - DNA, 528 bp, Homo sapiens
  misc_feature: GZ8MTXP02IQSHD.10.39.D06.1.454.CMB.2.raw
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggtgtcgtctataatgaataacgaccggccctcagggactcccgtgagccgattctctggctccaatcgggcaacncggccaccctnactcatcaccagggtcgaggccggggatcggacggccgactactacgtgtcaggtgtggggtatttcgactactgatcgagtggtggggtcttcgggcggacgggacagcgtcgaccgtactaagtcaacgccgaaggcgtacgccccgtcgtctccg

SEQ ID NO: 358313 - DNA, 627 bp, Homo sapiens
  misc_feature: GZ8MTXP02JPZX7.10.39.D06.1.454.CMB.2.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacacaattggaagtaatcgtgtgcactggtaccagcagaggccaggccaggcccctggtggttgtcgtctataatgaataacgacccggcctcgacgggactcccgtgagccgtattctcgtcggctaccaagttccgggacaacgaccggcccacccgtcactcatccaccgaggggtcggacgggccggggatcgggacggcccgacgtacctacgtacgtcgagggtggtgggtattttcgaacttacgtacggtacttcgtaggttcggggttcgggggttcgttaccgggggacggggtaacggggtaccgaaacggtccgtacggtacccgttaccgtaacggtacgaaccgtacccgtaacggcctaccggtcccccgtacggtacctacccg

SEQ ID NO: 358314 - DNA, 685 bp, Homo sapiens
  misc_feature: GZ8MTXP02IZMO3.10.39.D06.1.454.CMB.2.raw
  modified_base (250)..(250): a, c, t, g, unknown or other
  misc_feature (250)..(250): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacacaagttggaagtaatcgtgngcatcggtaccagcagacggccgaggccacggcccctggtggttcgtcgtctaactaatgaataaccgacccggccctgacgggactcccgtgacgtcgtattcctcgtcggctaccgaagttccggggacaaacgaccggaccctaccctacactaccatcccaaccgacggggttaccggacgggggccggggaacgtcgggaacgggtacccgtaaaccgttaccgtacgtacggtaccgtaaagggttcggttagggtactttcgaaccttacgtgaacgttcgtaggttcgggttagggggtcgttacggggacggggtaacgggaaccgtaaacggtccgtacggtacccggttaccgtaacggtaccgaaccggaacccgtaacggggtaccctacccggccccccgtttacggtacccgttaacccg

SEQ ID NO: 358315 - DNA, 524 bp, Homo sapiens
  misc_feature: GZ8MTXP02JR7N2.10.39.D06.1.454.CMB.2.raw
  modified_base (450)..(450): a, c, t, g, unknown or other
  misc_feature (450)..(450): n is a, c, g, or t
  modified_base (522)..(522): a, c, t, g, unknown or other
  misc_feature (522)..(522): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacacaattggaagtaatcgtgtgcactggtaccagcagaggccaggccaggcccctggtggttgtcgtctataatgataacgacccggcctcagggatcccgtgagccgattctcgtcggctccgaagttcgggcaacgcggccacctcatcatcaccgagggtcgagggccggggatcggacggaccgactacgtacgtgtcgaggtgtaggatttcactcngatcatggtggggtctcgggacggaggacctagcgtgaccgctaagcaagcccaggctcgacccctcggtcncg

SEQ ID NO: 358316 - DNA, 589 bp, Homo sapiens
  misc_feature: GZ8MTXP01C6I94.44.24.C02.1.454.CMB.2.raw
tcagacagtatatacacgaccggtgctcgatttagtacagatcgttagggaaagggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccagcaaatttcattggtaatcatgactatgtctctggtaccagcatcaccaggcacacgccccagactcgtgtattttgaggttcaataacgccgcccctcgacgggggtcccggatcggttctccgtggctccaagtctggacaacacggccctccctcgacccgtctcgtcgggctccgaggctgacgatggaggtctagtacttattactgcaggctaccgagtggagcaccgtatcgtatttgtacgtttcgggcgggtaacgggaccaggtaccttcggtaacccgtccgttaagggttccaaccggcccgtaaacggtccttcccggcccccgttccgggttcccaacccgtttcccg

SEQ ID NO: 358317 - DNA, 701 bp, Homo sapiens
  misc_feature: GZ8MTXP01BGEJD.44.24.C02.1.454.CMB.2.raw
tcagacagtatatacacgaccggtgctcgatttagtacagatcgttagggaaaggggggggtctcaggaggcagcgctctcaggacgtcaccaccatggcctgggctctgctcctcctcaccctcctcactcaggacacagggtcctgggcccagtctgccctgactcagcctccctccgcgtccggtctgtcggtcagtcagtcaccatctcctgcactggaaccagctaatttcattggtaatcatgactatgtctctggtacagcatccaccaggccacacgcccccagacctcgtgtagttttgagtacaagtacgcccgccccgtcgacggggtcccgagtccggttctccgtcggtctccgaagtcctacggaccaacgccggccctcccgtcgaccgtcgtcgtcgggcctcgacggtctacggtacgagttacggacgggtctaggtaactttacgttacgtcggtaccgtacggggtacccgttcccgggtaaagttccggggaacgggtaccctaacccgtttagttacggtttaagttttccgggttccgtttttacccgggggacggggttaaccggggaaccgttacggtaaccgttccggttaaacccggttccgttacgggttccaccggaaccccgtaacggtcccgtcccggtcccccgttccggtaaccttcccgtttccccg

SEQ ID NO: 358318 - DNA, 660 bp, Homo sapiens
  misc_feature: GZ8MTXP01DQ65M.44.24.C02.1.454.CMB.2.raw
  modified_base (262)..(262): a, c, t, g, unknown or other
  misc_feature (262)..(262): n is a, c, g, or t
tcagacagtatatacacgaccggtgctcgatttagtacagatcgttagggaaagggggggtctcaggaggcagcgctctcaggacgtcaccaccatggcctgggctctgctcctcctcaccctcctcactcaggacacagggtcctgggcccagtctgccctgactcagcctccctccgcgtccggtctgtcgtcagtcagtcaccatctcctgcactgaaccagctaatttcattgtaatcatgactatgtctctggtacngcatcaccagcacacgccccagactcgtgtattttgagtacaatacgccgtccctcgacgggtcccgatcggttctccgtcggctccgaagtctacggacaacgacggtccctcccgtgacccgtctcgtcgggcctccgacggtctaggacgaagtggacggtcttagtaatttacgttacgttgcctaagggtcccgttaccggtaagttacgggacggtccctaccgttagttacgttagttttccggtcgttttaccggggcgggtaacgggtaccgacggtaccgttccggtaacccggttccgttaaccgggttccaaccggtccccggtaaacgggtccccgttaccccggtcccccccgttccgggttaacccttcccgttttcccccgg

SEQ ID NO: 358319 - DNA, 549 bp, Homo sapiens
  misc_feature: GZ8MTXP01D2EDW.44.24.C02.1.454.CMB.2.raw
tcagacagtatatacacgaccggtgctcgatttagtacagatcgttagggaaagggggggtctcaggaggcagcgctctcaggacgtcaccaccatggcctgggctctgctcctcctcaccctcctcactcaggacacagggtcctgggcccagtctgccctgactcagcctccctccgcgtccggtctgtcggtcagtcagtcaccatctcctgcactggaaccagctaatttcattggtaatcatgacttatgtctctggtaccagcatcacccaggcacacgcccccagactcgtgtattttgaggttcaataagcccgccctcgacggggtcccgatcggttctcgtcggctcaagtctacggacaacgacggccctccctcgacccgtctcgtcgggctccgaggctgacgagtagaggtctgtattattactgcagctcgagtggagcactatcgtattgtcgtttcggcggtaaggcagtacttcgtaccgtcgttacggttcacgtcccgagcctccgccccgttcggtccttcgttcccg

SEQ ID NO: 358320 - DNA, 684 bp, Homo sapiens
  misc_feature: GZ8MTXP01BGB1H.44.24.C02.1.454.CMB.2.raw
  modified_base (231)..(231): a, c, t, g, unknown or other
  misc_feature (231)..(231): n is a, c, g, or t
  modified_base (313)..(313): a, c, t, g, unknown or other
  misc_feature (313)..(313): n is a, c, g, or t
tcagacagtatatacacgaccggtgctcgatttagtacagatcgttagggaaaggggggggtctcaggaggcagcgctctcaggacgtcaccaccatggcctgggctctgctcctcctcaccctcctcactcaggacacagggtcctgggcccagtctgccctgactcagccctccctccgcgtccggtctgtcggtcagtcagtcaccatctcctgcactaggaaccaanagtgacgtcggttcgttttgaccgttgtctccgtgtaccagcacgaccccaagaaaccacgacccccaaatcatttatttangcgtacaattcgttccgtccccgttcggtcgtccctgacgcgtcttctcgtcggtacctaagtccctaggacaaccgcccggtcccttaccctagaaccctatccgtcgtcgggtcctcgaggtctaggaggacggtagtcgttagtactttaactacgtagctacgcttacaattaacgtaacggtaaacggtacgggtaaaccttacgttttaacctagttaccggacgtacggacggtaaacctaagccgtacggtaacccgttccgttaaggtcccaaggtaccccgaacggttcccgttccccgttcccccgtcccgttaccgtaaccgttcccttcccggtttcccccctcccgttccgttaacc

SEQ ID NO: 358321 - DNA, 525 bp, Homo sapiens
  misc_feature: GZ8MTXP02IKODO.44.24.C02.1.454.CMB.2.raw
  modified_base (265)..(265): a, c, t, g, unknown or other
  misc_feature (265)..(265): n is a, c, g, or t
  modified_base (518)..(518): a, c, t, g, unknown or other
  misc_feature (518)..(518): n is a, c, g, or t
tcagacagtatatacacgaccggtgctcgatttagtacagatcgttagggaaaggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccagcaatttcattggtaatcatgactatgtctctggtaccngcatcaccaggcacacgcccccagactcgtgattttgaggtcaataagccgcccctcgacggggtcccgatcggttctcctggctcaagtctggcacgcggcctcctcgacccgtctcgtgggcctcaggctgacgatgagctgattatactgcagctcgatggagcactatgtatttgtcgttttcggcggtacggacctagacgtcgaccgtccgtaggtcacgcccgaacggcctcgccccctcggtccncgttccg

SEQ ID NO: 358322 - DNA, 504 bp, Homo sapiens
  misc_feature: GZ8MTXP02GVECG.44.24.C02.1.454.CMB.2.raw
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
tcagacagtatatacacgaccggtgctcgatttagtacagatcgttagggaaagggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccagcaatttcattggtaatcatgactatgtctctggtaccagcatcacccaggcacagcccccagactcgtgattttgaggtcaataagcgccctcagggtcccgatcggttctctggctcaagtctggcacgacgcctcctgacccgtctctgggctcgaggctgacgatgaggctgattatactgcagctanatananagtagaactacttactagtcgcgacgacggacagtctagaccgtcgtacgtcacgaaccgacgctccgccctcgtctactc

SEQ ID NO: 358323 - DNA, 663 bp, Homo sapiens
  misc_feature: GZ8MTXP02GESQE.44.24.C02.1.454.CMB.2.raw
  modified_base (434)..(434): a, c, t, g, unknown or other
  misc_feature (434)..(434): n is a, c, g, or t
tcagacagtatatacacgaccggtgctcgatttagtacagatcgttagggaaagggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccagcaaatttcattggtaatcatgactatgtctctggtaccagcatcacccaggccacaccgccccagtacctcgtagtttagttttaggagtactaaagtacgcccgtccccgtacgggtaccggggtccgtacgttccggttctccgtcggtcctacgagtcgtcgacaccgccgtccctccgtcgccgtctcggtcggccctacgnggtcgtacggaacgtgtacggacggtcttagttaaatttacgttacgtcgacgtacggtccgtacggaggttacgggacgaccctaacgttagtacgtttacggtttcgtttacccggtttcgggggaacggaaccggtaccgtaaagtccggtacggtaacccggttcgtacggaccgacggaacccgtaaggtcccgtcccggtcccccgtgtacccttacttcccg

SEQ ID NO: 358324 - DNA, 624 bp, Homo sapiens
  misc_feature: GZ8MTXP02F4FJ9.44.24.C02.1.454.CMB.2.raw
  modified_base (414)..(414): a, c, t, g, unknown or other
  misc_feature (414)..(414): n is a, c, g, or t
  modified_base (445)..(445): a, c, t, g, unknown or other
  misc_feature (445)..(445): n is a, c, g, or t
tcagacagtatatacacgaccggtgctcgatttagtacagatcgttagggaaagggggggtctcaggaggcagcgctctcaggacgtcaccaccatggcctgggctctgctcctcctcaccctcctcactcaggacacagggtcctgggcccagtctgccctgactcagccctccctccgcgtccggtctgtcggtcagtcagtcaccatcctcctgcactggaaccagctaaatttcattggtaatcatgactatgtctcctggtaccagcatcacccagccacacgcccccagactcgtgtattttgaggtacaagtaacgccgccctcgacggggtcccgatcggttctcgtggctcgagtctcggcacgccgcctcctgtaccgtctcgtgggcctcgacggctagacgntggagtctgtattattacgtgtcgatcctanattaacgtaacgtaaacggttaggtaaaccttacgttttaacgtacgttacgggacgtacgtaaacggggaccaaacggtcgttaccggtaaacccgttcgttaaaccggtaccgacccgtaacccgaaacggttcccgtacccggtacccccgtcggttacccgtaccctttccccgg

SEQ ID NO: 358325 - DNA, 557 bp, Homo sapiens
  misc_feature: GZ8MTXP02GFJY0.44.24.C02.1.454.CMB.2.raw
  modified_base (443)..(443): a, c, t, g, unknown or other
  misc_feature (443)..(443): n is a, c, g, or t
tcagacagtatatacacgaccggtgctcgatttagtacagatcgttagggaaaggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccagcaatttcatttggtaatcatgactatgtctcctggtaccagcatcacccaggcacacgcccccagacctcgtgtatttttgaggtacaataacgccgcccctcgacggggtccccgatccggttctccgtggcctccgaagtctcggcaccgaccggccctccctcgacccgtctcgtcgggctccgacggctgacgatggagctgtattattacngcagctcgatggagcactatgtatttgtcgttttcgggcggtacggaccgagtaccgtgacccgttcgtacggtcacgcccgaacggcctcgcccccgtcggtcctacttcccg

SEQ ID NO: 358326 - DNA, 497 bp, Homo sapiens
  misc_feature: GZ8MTXP01DKTD3.9.34.D01.1.454.CMB.2.raw
  modified_base (445)..(445): a, c, t, g, unknown or other
  misc_feature (445)..(445): n is a, c, g, or t
tcagtgatacgtctcacgaccggtgctcgatttagatcgtctgtgttgggtttgggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagccccaaagtcatcatttatgacaacatgaagcggccctcacggggtccctgccgattctccggctccaagtctggcacatcagcctccctgccatcactgggctccaggctgaggatgaggctgactattactgccagtcgtaatgacngttggcctaagttaccattcgtcttcggaactgggaccaaggtcaaccgtcg

SEQ ID NO: 358327 - DNA, 614 bp, Homo sapiens
  misc_feature: GZ8MTXP01CT7YK.9.34.D01.1.454.CMB.2.raw
  modified_base (314)..(314): a, c, t, g, unknown or other
  misc_feature (314)..(314): n is a, c, g, or t
  modified_base (316)..(316): a, c, t, g, unknown or other
  misc_feature (316)..(316): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgcctcagtgtctggggccccagggcagaggtcaccatctcgtgcactggaagtagctccaacatcgggcacgtatgatgtacactgtaccaaacacttccaggaacacgacccccaaagtcatcatttananaacacatacgacgcgcctacgacgggtccctacgaaccgtacttccgtccggctaccgaacgtctcgaccacactccacgtccctcccgtacgaccctactccgacgtcgggcctaccgaggtcggtaggaacgggtacgtacgggaacggtccgtacgtaactttaacgttaccgtacgtaccctaggttacgttaagtacgacgtacggttacgtaaaccttaaagttaacttacgttaccggttaacgttaccggaacgttacgggaacccgttaacggttccgaacccggttcg

SEQ ID NO: 358328 - DNA, 549 bp, Homo sapiens
  misc_feature: GZ8MTXP01AK7YZ.9.34.D01.1.454.CMB.2.raw
  modified_base (271)..(271): a, c, t, g, unknown or other
  misc_feature (271)..(271): n is a, c, g, or t
  modified_base (363)..(363): a, c, t, g, unknown or other
  misc_feature (363)..(363): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtcnctgcaactcaataaacctgagaggcgaggacacggccatttatttctgtgcgaaggaggcatatgggaagtacgattttcgatccctccgcngtcgacactttgattacgtggggcccggggaaccctggtcgccgtctcctcacgcctccaccaacgggcccatcggtccttcccccgtggccacccctcctccaagacgccacctcgtcgggggccacgcgcggcccgttgggcttgcctggttcaggctaactccaagcgtattcaacttgaacg

SEQ ID NO: 358329 - DNA, 541 bp, Homo sapiens
  misc_feature: GZ8MTXP01D6QCL.9.34.D01.1.454.CMB.2.raw
  modified_base (232)..(232): a, c, t, g, unknown or other
  misc_feature (232)..(232): n is a, c, g, or t
  modified_base (363)..(363): a, c, t, g, unknown or other
  misc_feature (363)..(363): n is a, c, g, or t
  modified_base (486)..(486): a, c, t, g, unknown or other
  misc_feature (486)..(486): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggcctatttattctgtgcgaaggaggcatagtgggaagtacgattttcgatccctcgcngtcgacactttgattacgtgggggcccgggtacctggtcgccgtctccgtcacgcctccaccaagggcccagtcggtcttcccgtctggccaccctcctccaagacgcacctcgtcgggggcncgaagccggccctgggctcgccttggttcaaggctactccagacttatcaacgtg

SEQ ID NO: 358330 - DNA, 552 bp, Homo sapiens
  misc_feature: GZ8MTXP01BVBFX.9.34.D01.1.454.CMB.2.raw
  modified_base (383)..(383): a, c, t, g, unknown or other
  misc_feature (383)..(383): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcaagtcgacactttgattacgnggggccggggaccctggtcgccgtctcctcagcctccaccaagggcccatcggtccttccccgtggccacccctcctccaacgacgccaccctcgtcgggggcacgacgcggcccgttgggccttgccgtggttcaggctaacttccaagcgtattcaacgttgaacgg

SEQ ID NO: 358331 - DNA, 612 bp, Homo sapiens
  misc_feature: GZ8MTXP01EBYUA.9.34.D01.1.454.CMB.2.raw
  modified_base (366)..(366): a, c, t, g, unknown or other
  misc_feature (366)..(366): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgagacacggcctatttattctgtgcgaaggaggcatagtgggaagtacgtattttcgactccctaccgcngtcgactactttgattacgtggggcccgggaccctggtccgccgtctcctcacgcctccaccgaacgggcccagtccggtccttcccccgtggccctaccccgtcctaccaacgacgcctaccctcggtcgggggccaccgcggcccggcccgttggggccttcggacccgttcgggttaccgaaacgggttacccttaaccttcccgaacggtaccggtaacttccgtaaccgttggaaccgggg

SEQ ID NO: 358332 - DNA, 583 bp, Homo sapiens
  misc_feature: GZ8MTXP01AWE7A.9.34.D01.1.454.CMB.2.raw
  modified_base (365)..(365): a, c, t, g, unknown or other
  misc_feature (365)..(365): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggcctatttatttctgtgcgaaggaggcatagtgggaagtacgtattttcgatccctccgcngtcgacactttgattacgtggggccgggaaccctggtcgccgtctcctcacgcctccaccaacgggcccactccggtccttcccccgtcggcccacccctccctaccaacgacgccacccgtcgtcgggggccaccgaggccggcccgttggggccttcggccgtggttccgaacggttacctaacttcccaagacgtattcctaacgttcggaacgg

SEQ ID NO: 358333 - DNA, 558 bp, Homo sapiens
  misc_feature: GZ8MTXP01BV6EH.9.34.D01.1.454.CMB.2.raw
  modified_base (360)..(360): a, c, t, g, unknown or other
  misc_feature (360)..(360): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaatacgattttcgatccctcgcngtcgacactttgattacgtggggcccgggaaccctggtcgccgtctcctcacgcctccaccaacgggcccatccggtccttcccccgtggccacccctcctccaagacgcaccctcgtcgggggcacgcgcggcccttggggccttggccctgggttccaagggacctaacttccaagacgtattcaacgttgaacgg

SEQ ID NO: 358334 - DNA, 588 bp, Homo sapiens
  misc_feature: GZ8MTXP01DZQTB.9.34.D01.1.454.CMB.2.raw
  modified_base (398)..(398): a, c, t, g, unknown or other
  misc_feature (398)..(398): n is a, c, g, or t
  modified_base (433)..(433): a, c, t, g, unknown or other
  misc_feature (433)..(433): n is a, c, g, or t
tcagtgatacgtctcacgaccggtgctcgatttagatcgtctgtgttgggtttgggctgacctggcttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccagggggagggactggagtgggtcgcaggcatcgctggtggcggtcatgacacattctacgcaaactccgtgagggccgcttcatcatctccagagacaattcccagaacatactgtctctgcaactcaaataacctgagaagcgaaggacacggccatttattctgtgcgaaaggnggcaatagtagggaagtacgtatttcgacttcccncgacagtcggactacgtttagacttacggcgggggcccgggtaacctcgggtccgcccgtcctccctcgaacgcccttccaaccgaacgggccctacgttccggttcccttcccccgtggccctaaccccttccaccgaaacgtcgcctaacccg

SEQ ID NO: 358335 - DNA, 498 bp, Homo sapiens
  misc_feature: GZ8MTXP01B1NGQ.9.34.D01.1.454.CMB.2.raw
  modified_base (361)..(361): a, c, t, g, unknown or other
  misc_feature (361)..(361): n is a, c, g, or t
  modified_base (435)..(435): a, c, t, g, unknown or other
  misc_feature (435)..(435): n is a, c, g, or t
  modified_base (464)..(464): a, c, t, g, unknown or other
  misc_feature (464)..(464): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagaggtcaccatctcgtgcactggaagtagctccaacatcggggcacgttatgatgtacactgtaccaacaacttccaggaacagcccccaaagtcatcatttatgacaacatcgaagcggccctcgacggggtccctgaacccgattccnccggctccaagtctggcacatcagcctccctggccatcactgggctccgagctgaggatgagctgactattctnccagtcgaatgcagttgacctaagttacnttcgtcttcggaactgggaccaggtcaaccgtcg

SEQ ID NO: 358336 - DNA, 553 bp, Homo sapiens
  misc_feature: GZ8MTXP01DUEO3.9.34.D01.1.454.CMB.2.raw
  modified_base (497)..(497): a, c, t, g, unknown or other
  misc_feature (497)..(497): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagaggtcaccatctcgtgcactggaagtagctccaacagtcggggcacgttatgatgtacactgtaccaacaacttccaggaacacgacccccaaagtcatcatttatgaacaacatcgaacgcggccctcgacggggtcccctagaacccgatttccgtcccgggctacccgaagtctggacacactcacgtcctccctaggccatcactggctcgaggctgaggatggagctgacttatactgacctgtcgtaatcgactaggttcggacccttaaagttaccnttccggtctttacgggaacgttcgggacccaaacgggttcccttaaccggttcccg

SEQ ID NO: 358337 - DNA, 531 bp, Homo sapiens
  misc_feature: GZ8MTXP01AM3ED.9.34.D01.1.454.CMB.2.raw
  modified_base (319)..(319): a, c, t, g, unknown or other
  misc_feature (319)..(319): n is a, c, g, or t
  modified_base (520)..(520): a, c, t, g, unknown or other
  misc_feature (520)..(520): n is a, c, g, or t
  modified_base (522)..(531): a, c, t, g, unknown or other
  misc_feature (522)..(531): n is a, c, g, or t
tcagtgatacgtctcacgaccggtgctcgatttagatcgtctgtgttgggtttggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacgngtcgtacctaaagtacagtcgttcgttaccggacgtcgggaaccgtaacggtccaacccgtccgtcgggtacaccgacccgaacggaccccaacccctacgtcgtccttacgttttcccgtaccccctaccccttcctacaacggtaccttactccaacgttcggacgggccgggtcgcgggggacgaacggggcacaagngnnnnnnnnnn

SEQ ID NO: 358338 - DNA, 635 bp, Homo sapiens
  misc_feature: GZ8MTXP01B3L42.9.34.D01.1.454.CMB.2.raw
  modified_base (233)..(233): a, c, t, g, unknown or other
  misc_feature (233)..(233): n is a, c, g, or t
  modified_base (273)..(273): a, c, t, g, unknown or other
  misc_feature (273)..(273): n is a, c, g, or t
  modified_base (321)..(321): a, c, t, g, unknown or other
  misc_feature (321)..(321): n is a, c, g, or t
  modified_base (378)..(378): a, c, t, g, unknown or other
  misc_feature (378)..(378): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccagaacatactgtcnctgacaactacaaataacctgagaggcgaggacacggctatttattcngtgacgaaggagcagtagtagggaacgtacgtattttccgacttccccgtaccgacngtccgtaactacgttttacgaagtttaccgggtcgggggaccccggggtaacccgtcgggtcccgtccggtcctcccgtacgaccgccctacccgaaccgaacgggccctacgtccggttcccttcccccggtcgcccctacccctcctacccaacgcgcctacccgtcgtcggggcacgcgccggcccgttgggcttcgcccgtggttaccgaacggacctaacctccgaacgtacgtattccaacgttgaacggg

SEQ ID NO: 358339 - DNA, 502 bp, Homo sapiens
  misc_feature: GZ8MTXP01DEGSB.9.34.D01.1.454.CMB.2.raw
  modified_base (467)..(467): a, c, t, g, unknown or other
  misc_feature (467)..(467): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatcgaagcggccctcaggggtcccctgcccgattcctccgggctccaagtctggcacatcagcctccctggccatcactgggctcaggctgaggatgagctgactatactgccagtcgtaatgacagttggacctaagttaacnttcgtcttcggaactgggaccaggtccaacgtccg

SEQ ID NO: 358340 - DNA, 594 bp, Homo sapiens
  misc_feature: GZ8MTXP01DIV2H.9.34.D01.1.454.CMB.2.raw
  modified_base (299)..(299): a, c, t, g, unknown or other
  misc_feature (299)..(299): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctggggaggcttggtccagcctggggagtccctgcgactctcctgtgtggcctctggattcacctttgagacctatgccttgacctgggtccgccaggctccgaggggaggactggagtgggtcgcaggcatcgctggtggcggtcatgacacattctacgcaaactccgtgagggccncttcatcatctccagagacaattcccagaacatactgtctctgcaactcaaataacctgagaaggcgaaggacacgggcctatttattctgtgcgaaggaggcatagtgggaaagttacgtatttcgactccctcgcagtcggactactttgattacgcggggccgggaaccctggccgtccgtctcctcaacgtcccttacccaaccgaacgggcccctaagttcccgggttccttccccccgtgggacccctaacccccgttccctacccgaaacgtccgcccgtaaccccgg

SEQ ID NO: 358341 - DNA, 556 bp, Homo sapiens
  misc_feature: GZ8MTXP01AL0KX.9.34.D01.1.454.CMB.2.raw
  modified_base (232)..(232): a, c, t, g, unknown or other
  misc_feature (232)..(232): n is a, c, g, or t
  modified_base (272)..(272): a, c, t, g, unknown or other
  misc_feature (272)..(272): n is a, c, g, or t
  modified_base (385)..(385): a, c, t, g, unknown or other
  misc_feature (385)..(385): n is a, c, g, or t
  modified_base (543)..(543): a, c, t, g, unknown or other
  misc_feature (543)..(543): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtcnctgcaactcaataacctgagaggcgaggacacggccatttatttctgtgcgaaggaggcatatggggaactacgattttcgactccctccgcaagtcgacactttgattacgnggggcccggggaaccctggtcgcgtctcctcacgcctccaccaacgggcccacgtcgtccttccccgtcggccaccctcctccacgacgccacctcctcgggggcacgcgcggcccgttgggcttgcctggttcgacggctaacttccaagacgtacnctaacttgaacgg

SEQ ID NO: 358342 - DNA, 547 bp, Homo sapiens
  misc_feature: GZ8MTXP01DQDRK.9.34.D01.1.454.CMB.2.raw
  modified_base (232)..(232): a, c, t, g, unknown or other
  misc_feature (232)..(232): n is a, c, g, or t
  modified_base (365)..(366): a, c, t, g, unknown or other
  misc_feature (365)..(366): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggcctatttatttctgtgcgaaggaggcatagtgggaactacgtattttcgatccctccgnngtcgactactttgattacgtgggggcccgggtacctggtcgccgtctcctcacgcctccaccacgggcccatcgtccttcccgtctcggccacccctcctccaacgacgccacctcgtcgggggccacgcgcggcctgggctcgccttggttcaacggctactccagacgttatcgcgtgg

SEQ ID NO: 358343 - DNA, 491 bp, Homo sapiens
  misc_feature: GZ8MTXP01AXB7Z.9.34.D01.1.454.CMB.2.raw
  modified_base (460)..(460): a, c, t, g, unknown or other
  misc_feature (460)..(460): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgccgatctccggctccaagtctgcacatcagcctccctggccatcactggctcagctgaggatgaggctgacttattactgccagtcgtaatgacagttggacctaagttacnttcgtcttgaactgggacaggtcaacgtccg

SEQ ID NO: 358344 - DNA, 505 bp, Homo sapiens
  misc_feature: GZ8MTXP01D62UI.9.34.D01.1.454.CMB.2.raw
  modified_base (469)..(469): a, c, t, g, unknown or other
  misc_feature (469)..(469): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgtatgatgtacactggtaccaacaacttcaggacacgaccccaaagtcatcatttatgacaacatcgaagcggccctcgacggggtcccctgaacccgattccgtccggctccaagtctggcacatcagcctccctgccatcactcggctccgagcgtagaggatgagctgactatctgccagtcgtaatgacagttcgacctaagttacnttcgtcttacggaactgggaccagtcgaaccgtccg

SEQ ID NO: 358345 - DNA, 555 bp, Homo sapiens
  misc_feature: GZ8MTXP01DP9GP.9.34.D01.1.454.CMB.2.raw
  modified_base (324)..(324): a, c, t, g, unknown or other
  misc_feature (324)..(324): n is a, c, g, or t
  modified_base (326)..(326): a, c, t, g, unknown or other
  misc_feature (326)..(326): n is a, c, g, or t
  modified_base (485)..(485): a, c, t, g, unknown or other
  misc_feature (485)..(485): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagcccgccctcagtgtcgtcggggcccccagggcagagagtcaccatctcgtgcactggaagtagctaccaacagtcgggcacgttatgatgtacactgtaaccaacaactccaggaacacgaccccaaagtcatacatttananaacaacatagaagccgccctcgaacgggtccctgacctattccgtccgcctaccaagtcctggaccaacataccacgccctccccgtggacccagtccacgtcgggcctcccgaggggctaggagatgagtctagtaactatactgccagtaacgtaanggacttagtacgaccttaaagttacatcgtacgttaacggaactcgggacctaacgggttcctaacccgg

SEQ ID NO: 358346 - DNA, 612 bp, Homo sapiens
  misc_feature: GZ8MTXP01DBFPF.9.34.D01.1.454.CMB.2.raw
  modified_base (271)..(271): a, c, t, g, unknown or other
  misc_feature (271)..(271): n is a, c, g, or t
  modified_base (322)..(322): a, c, t, g, unknown or other
  misc_feature (322)..(322): n is a, c, g, or t
  modified_base (379)..(379): a, c, t, g, unknown or other
  misc_feature (379)..(379): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacgaggtcctggcccagtctgttctgacgcacgcccgccctcagtcgtcgtcggggccccagggcaggaggtcaccatctcgtgcacgtggaagtagcctaccaacagtcgggcacgttangatgtacactgtaccaacactcaggaacacgaccccaaagtcatcatttanagaacacatacgaacgcgccctcgacggtcccagccgtatccgccgctacgaagtcncgcacatcacgccctccctggaccctatccgacgtcgggcctccgaggcgtaggaacggtatagggaacggtctagtaaccttacttaacgtcgtaccctaagttccgtaaatcggaacgtacgggttacgtaaacccgttaaaagttaaccgttacgttccggtttaaccgttaaccgggtaaacgttcggggaaacccttaaacgggttcccgaacccgggtttccccggg

SEQ ID NO: 358347 - DNA, 550 bp, Homo sapiens
  misc_feature: GZ8MTXP01D2UI1.9.34.D01.1.454.CMB.2.raw
  modified_base (320)..(320): a, c, t, g, unknown or other
  misc_feature (320)..(320): n is a, c, g, or t
  modified_base (507)..(507): a, c, t, g, unknown or other
  misc_feature (507)..(507): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtcgtgggccccagggcagaggtcaccatctcgtgcactggaagtagctccaacagtcggggcacgttatgatgtacactgtaccaacaactccaggaacacgacccccaaagtcatactatttanagaacaacatacgaagcggccctcgacggggtcccctagaacccgtacttccgtcccggcctaccaagtctggaccacactcacgccctcccgtcggccatccacgtcgggctccgaggcgtaggagagtgaggtctgacttattactcgacctagtcgtaatgacgtagttcggactaagttacgnttcgtcttacgggaactcgggaccaacggtccgaaccgtccgg

SEQ ID NO: 358348 - DNA, 573 bp, Homo sapiens
  misc_feature: GZ8MTXP01BHWHF.9.34.D01.1.454.CMB.2.raw
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgagggggaggactgggagtgggtcgcaggcatcgctgggtggcggtcatgacacattctacgcaaactccgtgaggggccgcttcatcatctccagagacaattcccagaacatactgtctctgcaacctcaaataacctgagaaggcgaaggacacgggccatttattctgtgcgaggaggcatatgggaaagtacgtatttcgactccctcgcagtcggactactttgagttacgtgggggccgggaaccctgggtccgcccgtctcctcaacgcccttccaccaacgggtccccagttcccggttccttcccccgtggcccaacccctcctcccaagcgctaacccg

SEQ ID NO: 358349 - DNA, 606 bp, Homo sapiens
  misc_feature: GZ8MTXP01D9RCX.9.34.D01.1.454.CMB.2.raw
  modified_base (233)..(233): a, c, t, g, unknown or other
  misc_feature (233)..(233): n is a, c, g, or t
  modified_base (273)..(273): a, c, t, g, unknown or other
  misc_feature (273)..(273): n is a, c, g, or t
  modified_base (366)..(366): a, c, t, g, unknown or other
  misc_feature (366)..(366): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccagaacatactgtcnctgcaactcaataacctgagaggcgaggacacggccatttatttctgtgcgaaggagcatagtgggaagtacgtattttcgactccctccgcngtcgactactttgattacgtcgggggcccgggaaccctggtcgccgtctcctcacgccctccaccgaacgggcccacgtccggttcccttcccccggtcggccctacccctccctacccaacgacgccacccgtcgtcgggggccacgacggccggcccgttgggggccttcggccgtcgggttcgaaacgggttaccttaaccttcccgaagtaccgtattccgaaccgttggaacggg

SEQ ID NO: 358350 - DNA, 595 bp, Homo sapiens
  misc_feature: GZ8MTXP01D6DJT.9.34.D01.1.454.CMB.2.raw
  modified_base (314)..(314): a, c, t, g, unknown or other
  misc_feature (314)..(314): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtcgtgggccccagggcagagggtcaccatctcgtgcactggaagtagctccaacatcggggcacgttatgatgtacactggtaccaacaactcagaacacgaccccaagtcatcatttanagacaaacatacgaacgcggccctcgacggggtcccctagaacccgtatttcccgcccgggcctacccgaagtctaggccaacatccagccctcccgtggccatcacgtcgggctaccgaggcgtaggaggtaactggacggtctacggtacttaatttacgtcacccgtaagttccggtaaatcggaagtacggttacggtaaccttaaagttaaaccgttcgttacgttccttacgggaacgttcgggacccgttaacggtccgttaacccggttccgg

SEQ ID NO: 358351 - DNA, 502 bp, Homo sapiens
  misc_feature: GZ8MTXP01CW2WV.9.34.D01.1.454.CMB.2.raw
  modified_base (423)..(423): a, c, t, g, unknown or other
  misc_feature (423)..(423): n is a, c, g, or t
  modified_base (474)..(474): a, c, t, g, unknown or other
  misc_feature (474)..(474): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggacagaccccaaagtcatcatttatgaacaacatcgaagcggccctcgacggggtcccctgccgattcctccggctccaagtctggcacactcacgccctccctggccatcactgggctccgaggctgaggntggagctgactattactgccagtcgtaatgacagttggacctaagttaacnttcgtctcgaactggacagtcaacgtcg

SEQ ID NO: 358352 - DNA, 510 bp, Homo sapiens
  misc_feature: GZ8MTXP01AR10N.9.34.D01.1.454.CMB.2.raw
  modified_base (418)..(418): a, c, t, g, unknown or other
  misc_feature (418)..(418): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagaggtcaccatctcgtgcactggaagtagctccaacatcggggcacgttatgatgtacactggtaccaacaacttccaggaacagcccccaaagtcatcatttatgaacaacatcgaagtgccctcgaggggtccctgccgatcctccggctccaagtctgcacatcagccctcctggccatcactggctcaggctgaggatgagcngactatactgccagtcgtaatgactaggttcggacctaagttaacgacttcgtcttcggaaacttgggacccaaggtccgaacccggttccg

SEQ ID NO: 358353 - DNA, 576 bp, Homo sapiens
  misc_feature: GZ8MTXP01AIBEE.9.34.D01.1.454.CMB.2.raw
  modified_base (232)..(232): a, c, t, g, unknown or other
  misc_feature (232)..(232): n is a, c, g, or t
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggccatttatttctgtgcgaaggaggcatagtgggaacgtacgattttcgactccctccgcngtcgactactttgattacgngggggcccgggaccctggtccgccgtctcctcacgccctccaccaacgggcccagtccggtccttcccccgtggcctacccctccctccaagacgccaccctcgtcgggggccacgcgccggcccgttggggccttcgccgtgggttccgacgggacctaacgttccaagcgtattcaacgttggaacgg

SEQ ID NO: 358354 - DNA, 555 bp, Homo sapiens
  misc_feature: GZ8MTXP01DFGX2.9.34.D01.1.454.CMB.2.raw
  modified_base (231)..(231): a, c, t, g, unknown or other
  misc_feature (231)..(231): n is a, c, g, or t
  modified_base (271)..(271): a, c, t, g, unknown or other
  misc_feature (271)..(271): n is a, c, g, or t
  modified_base (362)..(362): a, c, t, g, unknown or other
  misc_feature (362)..(362): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtcnctgcaactcaataacctgagaggcgaggacacggccatttattctgtgcgaaggaggcatatgggaaagtacgattttcgatccctccgcngtcgacactttgatttacgtgggggcccgggaaccctgtcgccgtctcctcagcctccaccaacggcccatccggtccttcccccgtcggccaccctcctccaagacgccacctcgtcgggggcacgagccggcccgttgggcttcgcctggttcgaggactaacttccaagacgtattctaacgttgaacgg

SEQ ID NO: 358355 - DNA, 584 bp, Homo sapiens
  misc_feature: GZ8MTXP01BHSJH.9.34.D01.1.454.CMB.2.raw
  modified_base (232)..(232): a, c, t, g, unknown or other
  misc_feature (232)..(232): n is a, c, g, or t
  modified_base (329)..(329): a, c, t, g, unknown or other
  misc_feature (329)..(329): n is a, c, g, or t
  modified_base (370)..(370): a, c, t, g, unknown or other
  misc_feature (370)..(370): n is a, c, g, or t
  modified_base (508)..(508): a, c, t, g, unknown or other
  misc_feature (508)..(508): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaaacatactgtctctgcaactcaataacctgagaggcgaggacacggccatttatttctgtgcgaaggnggcatagtggggaagtacggtattttcgatcccctaccgcngtcgactactttgatttacgtgggggcccggggtaaccctggtccgccgtctcctcacgccctaccaccgaacgggcccagtccggtcccttccccgtcggccacccctcctaccaagcgcacctcgtcggggcacgnggccggcccgttggggccttcggcccgtgggttccgaaggcctaacgttccaagacgtacttccaacgttgaacgg

SEQ ID NO: 358356 - DNA, 510 bp, Homo sapiens
  misc_feature: GZ8MTXP01DZS7C.9.34.D01.1.454.CMB.2.raw
  modified_base (367)..(367): a, c, t, g, unknown or other
  misc_feature (367)..(367): n is a, c, g, or t
  modified_base (479)..(479): a, c, t, g, unknown or other
  misc_feature (479)..(479): n is a, c, g, or t
tcagtgatacgtctcacgaccggtgctcgatttagatcgtctgtgtttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctgggccccagggcagagggtcaccatctcgtgcactggaagtagctccaacatcggggcacgttatgatgtacactggtaccaaacaacttccaggaacacgacccccaaagtcatcatttatgacaacatgaacgcggccctcgacggggtcccctgcccgtattccnccgggctccaagtctgcacatcacgccctccctggccatccacgtgggctccgaggctggaggatgaggctgactatactgccagtctaatgacagttggacctaagacttnttcgtcgtgaactgggaccagtcaaccgtcg

SEQ ID NO: 358357 - DNA, 590 bp, Homo sapiens
  misc_feature: GZ8MTXP01ET0TE.9.34.D01.1.454.CMB.2.raw
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcacgccgccctcagtgtcgtcgggccccagggcagaggtcaccatctcgtgcacgtggaagtacgctaccaacagtcggggctacgttatgatgtacactacgtaaccaacactcaggaacacgaccccaaagtcatactattatagacaaacatacgaacgccggcccgtcgaccggggtaccctacgcccgtattcccgtcccggacctaccgtaacgtctcggacacactccgacgccctacccgtcggaccctatccacgttcggcctaccgaggccgtaggaggtatcggagtcgtagtacttaattcgtcgacctagtcgtaatagaccgtagttacgtacctaaagttacgttcgttaccgtcgtacggtaacgtcgggaccgacggtccgttaacccggtccg

SEQ ID NO: 358358 - DNA, 785 bp, Homo sapiens
  misc_feature: GZ8MTXP01C64S4.9.34.D01.1.454.CMB.2.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgcctcagtgtctcggggccccagggcagagggtccaccatctcgtgcacgtggaagtagctccaacgagtcggggcacgttatgatgtacactggtaaccaaacaactaccaggaacacgaccccaaagtcatacattatacgaacaacatacgaacggcggcccgtacgacgggggtacccctaggaacccgtacgtttcccgtacccgggtacctacccgtaaacgtccgtacgggacctaacctacggttaccaaccggtccccttccccgtacgggtacccctaacgttcccgtaacccggttacgggggcccttaccccggaaacggggtcccggtttacggggaaacggggtagttacgggaaacggggtcccttaacgggtaaaccgtttaactttaaccgtccgggtaccccgtagggttacccgttaaagttcgggttaaacccgttaagggttaccgggtaaaccgtttaaaacgggttaaaccttcggtttaacccggtttaaccggtttacccggggtaaaacggtttacccgggggaaacccgttaaacggggtttaaccccgttaaccccgggtttaaccccgggg

SEQ ID NO: 358359 - DNA, 559 bp, Homo sapiens
  misc_feature: GZ8MTXP01DZ37H.9.34.D01.1.454.CMB.2.raw
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (363)..(363): a, c, t, g, unknown or other
  misc_feature (363)..(363): n is a, c, g, or t
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgnttcatcatctccaganacaattcccagaacatactgtctctgcaactcaaataacctgagaggcgaggacacggcctatttattctgtgcgaaggagcatatgggaatacgtattttcgatccctaccgcngtcgacactttgattacgtgggggcccgggaaccctggtcgccgtctcctcagcctaccaccaacgggcccatccggtccttcccccgtggccacccctcctaccaagacgcacctctgggggcacgngccggccgngggcttgcccgtggttcgaacggttacctaactccaagacgtacttcaacttggaacgg

SEQ ID NO: 358360 - DNA, 678 bp, Homo sapiens
  misc_feature: GZ8MTXP01ASUKZ.9.34.D01.1.454.CMB.2.raw
  modified_base (323)..(323): a, c, t, g, unknown or other
  misc_feature (323)..(323): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagcccgccctcagtgtcgtcggggccccagggcaggaggtccacatctcgtgcacgtggaagtagctccaacagtcgggcacgtatgatgtacactcggaaccaacactaccaggaacacgaccccaaagtcatctatttanagaacaacatacgacggcggacccgtcgacggggtaccctacgaacccgtacgttccgtccggcctaccgtaacgtctacggaccacactaccgacgcccttcccgtcggaccctaagttccgaaccgttcggggcccgttaccgaacggggtccggttagggaacggggtaacgttagggaacggtcgttaacggtaacctttaacgtttaaccgttcggacccgttaaggtccgtaagttcggaaccgttagggttacggtaacccttaaagttaccgttacgttaccggttaaccgttacgggtaaaccgttcgggaaacccgttacgggttccgttaacccggttcccggg

SEQ ID NO: 358361 - DNA, 584 bp, Homo sapiens
  misc_feature: GZ8MTXP01B9IZH.9.34.D01.1.454.CMB.2.raw
  modified_base (265)..(265): a, c, t, g, unknown or other
  misc_feature (265)..(265): n is a, c, g, or t
  modified_base (370)..(370): a, c, t, g, unknown or other
  misc_feature (370)..(370): n is a, c, g, or t
  modified_base (384)..(384): a, c, t, g, unknown or other
  misc_feature (384)..(384): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagcccgccctcagtgtctggggccccagggcagaggtcaccatctcgtgcactggaagtagctccaacagtcggggcacgttangatgtacactcgtaccaaacaacttccaaggaacacgaccccaaagtcatcatttatacgaacaacatacgaagcggccctcgacggggtccctgccgacttccnccggctaccagtcncggcacactcgacgtccctcccgtcggcccaactccgacgttcgggcctaccgaggccgtaggaggataggaggtcctagtacttaattacgtcgacctacgttcgtaatcggactaggttcggtaacctaagttaacacgttccgttaacgttacggaacgttcggggaaccgttaacggtccgaaccggttaacccgg

SEQ ID NO: 358362 - DNA, 605 bp, Homo sapiens
  misc_feature: GZ8MTXP01EJ0X9.9.34.D01.1.454.CMB.2.raw
  modified_base (329)..(329): a, c, t, g, unknown or other
  misc_feature (329)..(329): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtcgtggggccccagggcagaggtcaccatctcgtgcacgtggaaagtacgctaccaacagtcggggcacgttatgatgtacactggtaaccaaacaactccaaggaaccacgaccccaaagtcaatctatttanagaacaaacatacgaagcggaccctcgacggggtccctgaacccgtattccgtcccggctaccgaagtcgtacggaccacactccacgccctcccgtacggacctagtccacgtcgggcctaccgaggctaggaggtatggaggcctagaaccttattactgacctagtcgtaatgactaggttacggtaaccctaaagttaaccgttgttaccggttcgtttaccgggaacgttcgggggaacccttaaacggggttcccttaacccgggtcccg

SEQ ID NO: 358363 - DNA, 548 bp, Homo sapiens
  misc_feature: GZ8MTXP01AR340.9.34.D01.1.454.CMB.2.raw
  modified_base (321)..(321): a, c, t, g, unknown or other
  misc_feature (321)..(321): n is a, c, g, or t
  modified_base (506)..(506): a, c, t, g, unknown or other
  misc_feature (506)..(506): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtcgtcggggccccagggcagaggtcaccatctcgtgcacgtggaagtagctccaacagtcggggcacgttatgatgtacactggtaccaacaactccaggaacacgaccccaaagtcatcatttangacaacatacgaacgcggccctacgacggggtcccctagaacccgattcccgtccggctaccgaagtctcggcacatcacgccctcccgtcgccatccacgtcgggcctaccgaggctaggaggataggacggtctagacttattacgtgacctagtcgtaatgactaggttcgaacctaagacngttcgtcgttacggaactcgggaccttaggtccgaacgtccg

SEQ ID NO: 358364 - DNA, 529 bp, Homo sapiens
  misc_feature: GZ8MTXP01B4JMN.9.34.D01.1.454.CMB.2.raw
  modified_base (495)..(495): a, c, t, g, unknown or other
  misc_feature (495)..(495): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacagtcggggcacgttatgatgtacactggtaccaacaactccagttaacacgaccccaaagtcatctatttatagacaacatacgaacgcggccctcgacggggtaccctcgccgacttccgtccggctccaacgtctcgcacactcacgccctcccgtcggccactccacgtcgggcctccgaggcgtgaggagtggaggctgacttattactcgccagtcgtaatgactagttgactaagttacnttcgtctcggaacgtggaccgagtccgccgtccg

SEQ ID NO: 358365 - DNA, 623 bp, Homo sapiens
  misc_feature: GZ8MTXP01BRTJ6.9.34.D01.1.454.CMB.2.raw
  modified_base (319)..(319): a, c, t, g, unknown or other
  misc_feature (319)..(319): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagaggtcaccatctcgtgcactggaagtagcctaccaacagtcggggcacgttatgatgtacactggtaccaaacactccaggaacacgaccccaagtcatctattangacaacatacgaacgcggccctcgacggggtcccctgaacccgattcccgtccggcctccgaagtctcggacacactccacgtcccctcccgtacggcctactccacgtcgggcctccgaggcgtagaggatggacggtcctggtaccttaagtttaccgcggtaccctaaggttccgtaaagttcggaaaccgtagggttacggtaaacccttaaacggttaaacgttcgttaccggttaaccgtttaccgggaacgttaccggggaacccttaaacggggttcccttaacccggttcccggg

SEQ ID NO: 358366 - DNA, 585 bp, Homo sapiens
  misc_feature: GZ8MTXP01ALXGE.9.34.D01.1.454.CMB.2.raw
  modified_base (232)..(232): a, c, t, g, unknown or other
  misc_feature (232)..(232): n is a, c, g, or t
  modified_base (272)..(272): a, c, t, g, unknown or other
  misc_feature (272)..(272): n is a, c, g, or t
  modified_base (330)..(330): a, c, t, g, unknown or other
  misc_feature (330)..(330): n is a, c, g, or t
  modified_base (458)..(458): a, c, t, g, unknown or other
  misc_feature (458)..(458): n is a, c, g, or t
  modified_base (570)..(570): a, c, t, g, unknown or other
  misc_feature (570)..(570): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtcnctgcaactcaaataacctgagaggcgaggacacggctatttattctgtgacggaaggnggcagtagtgggaactacgtattttcgatccctcgctgtcgactcttgattcgcggggccgggacctggtccgccgtctcctcgacgccctaccaccgaacgggccctacgtccggtccttccccggnggccctaccctccctaccaacgacgccaccgtcggtcgggggccacgcggccggcccgttgggcttcgcccgtgggttcgaacgggttacctaacgttccgaagtacgtacncgtaacgttggcggg

SEQ ID NO: 358367 - DNA, 606 bp, Homo sapiens
  misc_feature: GZ8MTXP01BI3C3.9.34.D01.1.454.CMB.2.raw
  modified_base (317)..(317): a, c, t, g, unknown or other
  misc_feature (317)..(317): n is a, c, g, or t
  modified_base (362)..(362): a, c, t, g, unknown or other
  misc_feature (362)..(362): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggccagaggtcaccatctcgtgcactggaagtagctccaacatcggggcacgttatgatgtacactggtaccaacaacttccagaaccagaccccaaagtcatcatttangacaacatcgaacgcggccctcgacgggtccctagcccgattccncccgggctaccgaagtctcggacacatcacgcctcccgtggccatccacgtcggctcgacggcgtggaggatggacggctcgacttagttacgtcgaccctaggtccgtaagtacggaccgtaggttcggtaaccttaaacggttaaccttacggtttcccggttaaccggttttaccgggaaaccggtttaccgggggaaacccgttaacggggttaaccccgttaaccccggtttcccgggg

SEQ ID NO: 358368 - DNA, 593 bp, Homo sapiens
  misc_feature: GZ8MTXP01EDTB6.9.34.D01.1.454.CMB.2.raw
  modified_base (232)..(232): a, c, t, g, unknown or other
  misc_feature (232)..(232): n is a, c, g, or t
  modified_base (366)..(366): a, c, t, g, unknown or other
  misc_feature (366)..(366): n is a, c, g, or t
  modified_base (385)..(385): a, c, t, g, unknown or other
  misc_feature (385)..(385): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggcctatttattctgtgacgaaggaggcatagtgggaagtacgtatttcgactccctccgcngtcactactttgattacgngggggacccgggaccgtggtccgccgtctcctcacgcctaccaccgacgggcccagtccggtcccttcccccggcggccctacccctcctaccgaacgcgccaccgtcgtcgggggccacgcggccggcccttggggccttcggcccgtcggttacgaacgggttaccttaaccttccgaacgtacgtacttccaacgttggaacggg

SEQ ID NO: 358369 - DNA, 561 bp, Homo sapiens
  misc_feature: GZ8MTXP01EB799.9.34.D01.1.454.CMB.2.raw
  modified_base (273)..(273): a, c, t, g, unknown or other
  misc_feature (273)..(273): n is a, c, g, or t
  modified_base (364)..(364): a, c, t, g, unknown or other
  misc_feature (364)..(364): n is a, c, g, or t
  modified_base (547)..(547): a, c, t, g, unknown or other
  misc_feature (547)..(547): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgccaaactccgtgaggggccgcttcatcatctccagagacaattcccagaacatactgtcnctgcaactcaataacctgagaggcgaggacacggccatttatttctgtgcgaaggaggcatatgggaagtacgattttcgatccctccgcngtcgacactttgattacgtggggcccgggaaccctggtcgccgtctcctcacgcctccaccgaacgggccccagtccggtccttccccgtcggccaccctcctccaagcgcacctcgtcgggggcacgagccggcccgttggggccttggcctggttcgaacggactaacttcaacgacgtancaacgttgaacggg

SEQ ID NO: 358370 - DNA, 611 bp, Homo sapiens
  misc_feature: GZ8MTXP01ECN6S.9.34.D01.1.454.CMB.2.raw
  modified_base (233)..(233): a, c, t, g, unknown or other
  misc_feature (233)..(233): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggcctatttatttctgtgcggaaggagcatagtgggaacgtacgtatttcgactccctcgcaagtcactactttgacgttacggcgggggcccgggtaccgtggtcgtccgtctcctcacgccctaccaccgaacgggcccacgtccggtcccttcccccggtggcccctacccctccctaccaacgacgccacccgtcggtcggggccacgcggccggtcccgttgggtccttcgtcccgtcggttaccgaacggttaccttaaccgttccgaaggtaccgtattccgtaacgttcggaaccggg

SEQ ID NO: 358371 - DNA, 627 bp, Homo sapiens
  misc_feature: GZ8MTXP01CU0W8.9.34.D01.1.454.CMB.2.raw
  modified_base (272)..(272): a, c, t, g, unknown or other
  misc_feature (272)..(272): n is a, c, g, or t
  modified_base (319)..(319): a, c, t, g, unknown or other
  misc_feature (319)..(319): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtcnctgcaactacaataacctgagaggcgaggacacggcctatttattcngtgcgaaggagcatagtagggaactacgtattttcgactccctccgcaagtcgactactttgattacgtggggacccgggaccctggtcgccgtctcctcacgccctaccaccgaacgggcccagtccggttccttcccccgtcggccctacccctccctaccaaacgcgcctacccgtcgtcgggggaccaccgacggcccggtccccgttcggggtccttcggtcccgtgggttacccgaaacgggttacccttaaccgtttccccgaacggtaccggttacttaccctaaccgttcgggaacggg

SEQ ID NO: 358372 - DNA, 735 bp, Homo sapiens
  misc_feature: GZ8MTXP01AQ3JI.9.34.D01.1.454.CMB.2.raw
  modified_base (265)..(265): a, c, t, g, unknown or other
  misc_feature (265)..(265): n is a, c, g, or t
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagaggtcaccatctcgtgcactggaaagtagcctccaacatcggggcacgttangatgtacactcggtaaccaaacaacttccaggaaccacgaccccaaagtcatcatttangacaanatcgaacgcggccctcgacggggtcccctacgaacccgtactttcccgtcccgggtccctacccgtaaacggtcttacgggaccaaccgaacttccgaaccggtccccttccccgttcgggacccctaacttcccgaaccgttcggggcccttacccggaacgggtccggttaggggaaacggggtaattcggggaacgggtcctacggtaaccgtttaattaaccgtcggtaccctaggttacccggtaatacgggttaacctaagggttccggaaaccccgtttaaaggttaaacccgttcgtttaacccgggtttaaccggtttaacccgggggtaaacctttaccggggggaaacccgttaaaaccgggggtttccccgaaaccccgggttttccccgggg

SEQ ID NO: 358373 - DNA, 580 bp, Homo sapiens
  misc_feature: GZ8MTXP01CQXKA.9.34.D01.1.454.CMB.2.raw
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgagggggagggactggagtgggtcgcaggcatcgctggtggcggtcatgacacattctacgcaaactccgtgagggccncttcatcatctccaganacaattcccagaacatactgtctctgcaacctcaaataacctgagaaggcgaaggacacggcctatttattctgtgcgaaggaggacatagtagggaagtacgtattttcgactccctcgcagtcgactactttgagttacgtcgggggcccgggtacccgtggtccgcccgtctccctcaacgcccttccacccgaacgggcccctagttccggttccttcccccgtggccctaaccctccctaccaacgcgccaacccg

SEQ ID NO: 358374 - DNA, 588 bp, Homo sapiens
  misc_feature: GZ8MTXP01EZO74.9.34.D01.1.454.CMB.2.raw
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
  modified_base (505)..(505): a, c, t, g, unknown or other
  misc_feature (505)..(505): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctaacgcaaaactccgtgaggggccgcttcatcatctccagagacaaattcccagaacatactgtctctgcaacctcaaataaaccngagaagngngacacgcatttattctgtgngaagagganatagtaggaagtacgtatttacgtactccctccgcagtacggactacttagtagttacgtcggggccgggggaacccggtacggtccggtccgtccgtcctcncgccttcccacccgaaaccggacccgacgttcggttcccgttccccgtccgccgaaccctccctaccaacgaacgcgtaaccg

SEQ ID NO: 358375 - DNA, 567 bp, Homo sapiens
  misc_feature: GZ8MTXP01A83FA.9.34.D01.1.454.CMB.2.raw
  modified_base (232)..(232): a, c, t, g, unknown or other
  misc_feature (232)..(232): n is a, c, g, or t
  modified_base (364)..(364): a, c, t, g, unknown or other
  misc_feature (364)..(364): n is a, c, g, or t
  modified_base (499)..(499): a, c, t, g, unknown or other
  misc_feature (499)..(499): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggccatttatttctgtgcgaaggaggcatagtgggaagtacgattttcgatccctccgcngtcgacactttgattacgtgggggcccgggaaccctggtccgccgtctcctcacgccctccacccaagggccccatcggtccttcccccgtcggccacccctcctccaacgacgccacctcgtcgggggccacgnggccggcccgttggggccttggccctggttcgaggactaacttccaagacgtattcaacgttgaacgg

SEQ ID NO: 358376 - DNA, 630 bp, Homo sapiens
  misc_feature: GZ8MTXP01CQCTT.9.34.D01.1.454.CMB.2.raw
  modified_base (268)..(268): a, c, t, g, unknown or other
  misc_feature (268)..(268): n is a, c, g, or t
  modified_base (492)..(492): a, c, t, g, unknown or other
  misc_feature (492)..(492): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagcccgccctcagtgtctcggggccccagggcagagggtccaccatctcgtgcactggaagtagctccaacagtcggggcacgttangatgtacactggaccaaacaacttccaaggaacacgacccccaaagtcaatactaatttaatgaaaccaaacatacgaacgccggccctcgacggggtcccctagaacccgtactttccgcccgggtcctaccaacgttctgaccacactcacgccctccctggcccatccacgtcggcctcgaggctaggaggactggacggtctagtacttaactttaccgnggtaccctaggttaccgtaattcggaacgtaggttcgggtaaacccttaaagttaaccgacttccggttaaccgtttacgggtaaaccgttaccgggggaacccttaaccggggttccgttaaccccgggtttcccgg

SEQ ID NO: 358377 - DNA, 706 bp, Homo sapiens
  misc_feature: GZ8MTXP01CUZ6I.9.34.D01.1.454.CMB.2.raw
  modified_base (215)..(215): a, c, t, g, unknown or other
  misc_feature (215)..(215): n is a, c, g, or t
  modified_base (250)..(250): a, c, t, g, unknown or other
  misc_feature (250)..(250): n is a, c, g, or t
  modified_base (376)..(376): a, c, t, g, unknown or other
  misc_feature (376)..(376): n is a, c, g, or t
  modified_base (409)..(409): a, c, t, g, unknown or other
  misc_feature (409)..(409): n is a, c, g, or t
  modified_base (424)..(424): a, c, t, g, unknown or other
  misc_feature (424)..(424): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctggggggaggcttggtccagcctggggagtccctgcgactctcctgtgtggcctctggattcacctttgagacctatgccttgacctgggtccnccaggctccgagggggaggactgggagtggggtcncaggcatcgctgggtggcggtcaatgacacattctacgcaaaactcccgtagacgggccgcttcattcatctccagacgacaattccccaagaacatactgtactctgacaaactcaaattaaccngaagaaggcgaagacacggactaatttattcgngtgacgaaggagganatagtagggaaagtacgtaattttcggaacttccccgtacgacgtacggtacgtaacccttaacgtttaggtaacgtttaaaccggtccggggggaccccggggtaaaccccgttcgggggttcccgacccgggttaccgtaccccttccgtaaccggcccccttaccgaaaccccggaaacggggtccccctaacgttccccggggttccctttccccccgtaacgggcccctaaccccccgttcctaacccaaaccggtaacggttccctaacccccggg

SEQ ID NO: 358378 - DNA, 592 bp, Homo sapiens
  misc_feature: GZ8MTXP01A1ZTT.9.34.D01.1.454.CMB.2.raw
  modified_base (366)..(366): a, c, t, g, unknown or other
  misc_feature (366)..(366): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggcctatttattctgtgcgaaggagcatagtgggaacgtacgtattttcgatccctaccgcngtcgactactttgattacggtggggcccgggaaccctggtccgccgtctcctcacgccctccaccgaacggccccagtccgggttcccttcccccgtcgggcccacccctccctaccaaacgcgccaccgtcgtgggggccacgacggccgggtcccgttgggccttcgcccgtggttaccgacggttacctaaccgttccaacgcgtacacgtcgaacggcgggg

SEQ ID NO: 358379 - DNA, 563 bp, Homo sapiens
  misc_feature: GZ8MTXP01D9FMX.9.34.D01.1.454.CMB.2.raw
  modified_base (248)..(248): a, c, t, g, unknown or other
  misc_feature (248)..(248): n is a, c, g, or t
  modified_base (318)..(318): a, c, t, g, unknown or other
  misc_feature (318)..(318): n is a, c, g, or t
  modified_base (466)..(466): a, c, t, g, unknown or other
  misc_feature (466)..(466): n is a, c, g, or t
  modified_base (506)..(506): a, c, t, g, unknown or other
  misc_feature (506)..(506): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagaggtcaccatctcgtgcacgtggaagtagctccaanagtcggggcacgttatgatgtacactaggtaccaacacttcaggaacacgaccccaaagtcatctattangacaacatcgaagcggccctcgacggggtcccctgaaccgattccgtcccggactaccgaacggtctacgccacactccacgtcccctcccgtcgacctatcacgtcgggctcgacggcgtgaggtatggaggtctgtactaatttcngcctagttcgaatgacgtagttcggaccttaagttacttnttccggttaacttacggaacgttacgggacccaagggtcccgttaaccggttcccgg

SEQ ID NO: 358380 - DNA, 536 bp, Homo sapiens
  misc_feature: GZ8MTXP01BPSJN.9.34.D01.1.454.CMB.2.raw
  modified_base (315)..(315): a, c, t, g, unknown or other
  misc_feature (315)..(315): n is a, c, g, or t
  modified_base (492)..(492): a, c, t, g, unknown or other
  misc_feature (492)..(492): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagaggtcaccatctcgtgcactggaagtagctccaacgatcggggcacgtatgatgtacactggtaaccaacaacttcaggacacgaccccaagtcatcatttanagacaacatacgaagcggccctcgacggggtccctgaaccgtattccctccggctccaagtctcgcacactcacgccctcccgtacggccatccacgtcgggctccgaggcgtgaggtatggacggctagaccttattactgcctagtcgtaatgactggttcgacctaagttaacngttcgtcgtttacggaacgttcgggaccaggtccaaccggtccg

SEQ ID NO: 358381 - DNA, 535 bp, Homo sapiens
  misc_feature: GZ8MTXP01BLHEP.9.34.D01.1.454.CMB.2.raw
  modified_base (226)..(226): a, c, t, g, unknown or other
  misc_feature (226)..(226): n is a, c, g, or t
  modified_base (305)..(305): a, c, t, g, unknown or other
  misc_feature (305)..(305): n is a, c, g, or t
tcagtgatacgtctcacgaccggtgctcgatttagatcgtctgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctctgcactggaaccngcagtgatggttgggattatgaccttgtctcctggtaccaacagcacccaggaccaaacgcccccaaatcatcatttangagtcactaagcgcctgtagggtttctattcgcttctctgctcaaatctgacacacgcctcctgacactctctggctcgaggctaggaggacgaggctagtattattacgtggcttgctacatagtgcagtgtggtacgactcgtaacccggtggttacggttcgggacggacggggtacaacgggttcgaccgtctacggtcacggcccgacgtcgttcccggtccccg

SEQ ID NO: 358382 - DNA, 725 bp, Homo sapiens
  misc_feature: GZ8MTXP01EV2TN.9.34.D01.1.454.CMB.2.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagaggtcaccatctcgtgcacgtggaagtagctccaacatcggggcacgttatgatgtacactgtaccaacaactccaggaacacgaccccaaagtcatctatttatagacaaacatacgaacgcggccctcgacggggtcccctaggaacccgtactttcccgtcccggcctacccgtaaaggtccgttacgggaccaacaacttccgaacgtccccttccccgttcggaccctaactccgaacgttcggggacccttacccgaagggtccgttagggaagggtacgttacgggaacgggtcctacggtaacctttaaacgtttaccgttacggacccgtaagggttcccggttaagttcggttaaaccggtaacgggtttaccggggtaaacccctttaaaagggttaaaccgttacgtttaccgggtttaacccggttttaaccggggaaaccggtttacgggggaaccccgttaaaacggggttcccgttaaccccgggtttccccgggg

SEQ ID NO: 358383 - DNA, 529 bp, Homo sapiens
  misc_feature: GZ8MTXP01ANQ84.9.34.D01.1.454.CMB.2.raw
  modified_base (249)..(249): a, c, t, g, unknown or other
  misc_feature (249)..(249): n is a, c, g, or t
  modified_base (321)..(321): a, c, t, g, unknown or other
  misc_feature (321)..(321): n is a, c, g, or t
  modified_base (361)..(361): a, c, t, g, unknown or other
  misc_feature (361)..(361): n is a, c, g, or t
  modified_base (486)..(486): a, c, t, g, unknown or other
  misc_feature (486)..(486): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctcggggccccagggcagaggtcaccatctcgtgcactggaagtagctccaanagtcggggcacgttatgatgtacactggtaaccaacaacttccaggaacacgcccccaaagtcatcatttangacaacatcgaagcgccctcgagggtccctgccgattccnccggctccaagtctcggcacatcacgccctccctcggccatcacgtgggcctcgagcgtggacggatggaggtctagacttatactggacctgtcggaatgactggttacggaccttaagttacngttcgtcgttacggaacttgggaaccaggtccgaacgttccgg

SEQ ID NO: 358384 - DNA, 556 bp, Homo sapiens
  misc_feature: GZ8MTXP01BUZS7.9.34.D01.1.454.CMB.2.raw
  modified_base (364)..(364): a, c, t, g, unknown or other
  misc_feature (364)..(364): n is a, c, g, or t
  modified_base (383)..(383): a, c, t, g, unknown or other
  misc_feature (383)..(383): n is a, c, g, or t
  modified_base (542)..(542): a, c, t, g, unknown or other
  misc_feature (542)..(542): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatagtgggaacgtacgattttcgatcccctcgcngtcgacactttgattacgnggggaccgggacccgtggtcgccgtctcctcacgcctccaccaacggcccatccgtccttccccgtcgccgacccctccctccacgacgccaccctcgtcgggggccacgcgcggcccttgggccttcgcctggttcgaggacctcttccaacgcgtanctaacgttgaacgg

SEQ ID NO: 358385 - DNA, 744 bp, Homo sapiens
  misc_feature: GZ8MTXP01DPM60.9.34.D01.1.454.CMB.2.raw
  modified_base (214)..(214): a, c, t, g, unknown or other
  misc_feature (214)..(214): n is a, c, g, or t
  modified_base (301)..(301): a, c, t, g, unknown or other
  misc_feature (301)..(301): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccnccaggctccgaggggaggactgggagtgggtcgcaggcagtcgctgggtggcggtcatgacacattcacgcaaactcgtgagggccncttcatcatctcagacacaactcccaagaacatactgttctctgaccaaacctcaaataacctgaagaaggcgaaggacaaccgggtcctaatttacgttctggtacgacgaaaggtaggactaagttaagtaggggtaaagttacggttactttttaccggaacttccccgtaccgtaccgtaacggttaccgggtaacgttaaccggttttacgggtttaacccgggtacgggggggtacccccgggggttaaaccccgttcgggggttacccggtccccgggttcccttccccgttaccgaaccggtccccttacccgaacccgggtaaaccgggccccttaaacgtccccgggtttcccctttcccccgttaccgggtaacccctaccccgttccccgtacccgaaaacggttccgtcccgttaacccgttcccggggg

SEQ ID NO: 358386 - DNA, 582 bp, Homo sapiens
  misc_feature: GZ8MTXP01B652O.9.34.D01.1.454.CMB.2.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggcctatttatttctgtgcggaaggaggcatagtggggaaacgtacggtattttcgactcccctaccgcaagtcgactactttgattacgtcgggggcccgggtaacctggtcgccgtctcctcacgcctccaccgaacggcccagtccgtcccttccccgtggtccctaccccgtcctaccaacgacgccaccgtcgtcgggggccacgcggccggcccgttgggcttcgcctggttcaggacctaacttccaagtacgtattctaacgttgaacgg

SEQ ID NO: 358387 - DNA, 568 bp, Homo sapiens
  misc_feature: GZ8MTXP01AOZC8.9.34.D01.1.454.CMB.2.raw
  modified_base (487)..(487): a, c, t, g, unknown or other
  misc_feature (487)..(487): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcacgccgccctcagtgtctcggggccccagggcagacggtcaccatctcgtgcacgtggaagtagctccaacagtcggggcacgttatgatgtacactgtaccaacaacttccaaggaacacgaccccaaagtcatcatttatagacaaacatacgaacgcggccctcgacggggtccctgaaccgacttcgtccggctccgaagtcgtcgcacatcgacgccctcccgtggaccatccacgttcgggcctccgagggctggaggagtcgaggcctagacttagttactgacctagtcgtaatcgacnggttacgaccttaaagttaccttacgttccgttaacgtacgggtaacgtcgggaaccttacgggtccgaaccggttcccgg

SEQ ID NO: 358388 - DNA, 547 bp, Homo sapiens
  misc_feature: GZ8MTXP01AE1TQ.9.34.D01.1.454.CMB.2.raw
  modified_base (309)..(309): a, c, t, g, unknown or other
  misc_feature (309)..(309): n is a, c, g, or t
  modified_base (338)..(338): a, c, t, g, unknown or other
  misc_feature (338)..(338): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgcctcagtgtctgggccccagggcagaggtcaccatctcgtgcactggaagtagctcaacatcgggcacgttatgatgtacactggtaccaacactccaggaacacgccccaaagtcatcattangacacatcgaagcgccctgacgggtcccngccgattccgccggctaccgaagtctcggcacactcacgccctcccgtggccatcaccgtgggcctaccgaggccgtgaggactgacgggtctggacttagttactggacctagtcgtaatgacgtagttcgggtaccctaaaggttaccttgttaccggttcttacgggaacgttcggggaccttaacggtcccgaaccgttcccggg

SEQ ID NO: 358389 - DNA, 530 bp, Homo sapiens
  misc_feature: GZ8MTXP01CQ3QO.9.34.D01.1.454.CMB.2.raw
  modified_base (262)..(262): a, c, t, g, unknown or other
  misc_feature (262)..(262): n is a, c, g, or t
  modified_base (322)..(322): a, c, t, g, unknown or other
  misc_feature (322)..(322): n is a, c, g, or t
  modified_base (337)..(337): a, c, t, g, unknown or other
  misc_feature (337)..(337): n is a, c, g, or t
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagaggtcaccatctcgtgcactggaatagctacaacagtcgggcaacgttangatagtacactacggaaccaacaactccaggaacacgtaccccaaagtcatacatttagnaacaacatacgaacncggcctacgacggggtaaccngaaccgnttccgccgctaccaacgtcgtgcacaccncncnccnccncgcacncgacgcgcgcgacgcggtgagagagcgcgtcgtactactcgtcgacgtcgtgtgtgagtacgacgtacgtaacgttacgttcgttacgtaacgtacgtaacgtacgacgacgtcgcgtcg

SEQ ID NO: 358390 - DNA, 553 bp, Homo sapiens
  misc_feature: GZ8MTXP01A7XCD.9.34.D01.1.454.CMB.2.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagcccgccctcagtgtctggggcccccagggcagagggtcaccatctcgtgcactggaaagtagctccaacatcggggcacgttatgatgtacactggtaaccaacaacttccaggaaccacgacccccaaagtcatctatttatagacaacatacgaacgcgccctcgacggggtcccctgaaccgtacttccgtccggctaccaagtctgcacatcacgccctcctgccatcacgtcggctccgaggcgtggacggatggagctagacttagttactcgacctagtcgtaatcgactagttcggtacctaaagttaccttgttccgttcgtacggtaacgtacgggaccaacggtccgaaccggttccgg

SEQ ID NO: 358391 - DNA, 619 bp, Homo sapiens
  misc_feature: GZ8MTXP01DRBOP.9.34.D01.1.454.CMB.2.raw
  modified_base (232)..(232): a, c, t, g, unknown or other
  misc_feature (232)..(232): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgagggccncttcatcatctccagagacaattcccagaacatactgtctctgcaactcaataacctgagaggcgaggacacggcctatttattctgtgacgaaggagcatagtaggaacgtacgtatttcgactccctccgcaagtcgaactacgttttgaacgttacgtcgggggacccggggtaacccgtgggtccgccgtctcctcacgtccctaccaccgaacgggccccagtccgttcccttcccccgtcggtccctacccctcctaccaacgtcgccacccgtcgtcgggggaccacgcggccggcccgttggggccttcggcccgtgggttaccgaacgggttaccttaacgttcccgaagaccgttattccgtaacgttcggaacggg

SEQ ID NO: 358392 - DNA, 630 bp, Homo sapiens
  misc_feature: GZ8MTXP01BQ78W.9.34.D01.1.454.CMB.2.raw
  modified_base (322)..(322): a, c, t, g, unknown or other
  misc_feature (322)..(322): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcacgcccgccctcagtgtcgtggggccccagggcagaggtccaccatctcgtgcactggaagtagctccaacagtcgggcacgtatgatgtacactgtaaccaacaactaccaaggaacacgaccccaaagtcatctatttanagaacaacatacgaacgcgcccgtacgacggggtcccctagaacccgtacttccgtcccgggtcctaccgaacgtcgtacggcctaacactaccacgtccccttcccgtacggccctaactccgaccgtcggggcctaccgaacgggcttaggaacgggtaatggacgggtctacgtaactttaacttacgtcgacccgtagtcgtaatcggacgtaacgttggaacccttaaaggttaacttcgttaccgttaaccgtttacggaacgttcgggaaccgaaacggttcccgaacccggtttcccggg

SEQ ID NO: 358393 - DNA, 536 bp, Homo sapiens
  misc_feature: GZ8MTXP01EYH1E.9.34.D01.1.454.CMB.2.raw
  modified_base (232)..(232): a, c, t, g, unknown or other
  misc_feature (232)..(232): n is a, c, g, or t
  modified_base (271)..(271): a, c, t, g, unknown or other
  misc_feature (271)..(271): n is a, c, g, or t
  modified_base (366)..(366): a, c, t, g, unknown or other
  misc_feature (366)..(366): n is a, c, g, or t
  modified_base (441)..(441): a, c, t, g, unknown or other
  misc_feature (441)..(441): n is a, c, g, or t
  modified_base (452)..(452): a, c, t, g, unknown or other
  misc_feature (452)..(452): n is a, c, g, or t
  modified_base (476)..(476): a, c, t, g, unknown or other
  misc_feature (476)..(476): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccnttcatcatctccagagacaattcccagaacatactgtcnctgcaactcaataaacctgagaggcgaggacacggccatttatttctgtgcgaaggaggcatatgggaaatacggtattttcgatccctaccgcngtcgacactttgattacgtggggccgggaccctggtcgcgtctcctcagcctcaccaaggcccatcgtctccccnggccacctccnccaagcgcacctcgtggggcacgngccgccttgggcttgcctggttcacggactaacttccaagacgtattcaacgttgaacgg

SEQ ID NO: 358394 - DNA, 590 bp, Homo sapiens
  misc_feature: GZ8MTXP01DYRWU.9.34.D01.1.454.CMB.2.raw
  modified_base (233)..(233): a, c, t, g, unknown or other
  misc_feature (233)..(233): n is a, c, g, or t
  modified_base (369)..(369): a, c, t, g, unknown or other
  misc_feature (369)..(369): n is a, c, g, or t
  modified_base (578)..(578): a, c, t, g, unknown or other
  misc_feature (578)..(578): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccagaacatactgtctctgcaactcaaataaacctgagaggacgaggacacggcctatttattctgtgcgaaggagcatagtgggaatacgtattttcgactcccctacgcngtcgactactttgattacgtgggggacccgggaaccctggtccgccgtctcctcacgccctaccaccgaaacgggcccacgtccggttcccttcccccgtcggccctacccctccctacccaaacgacgaccacccgtcgtcgggggccacgacggccggcccgttgggcttcggccgtggttcgaacggactaactccaacgacgtanctaacgttgcgg

SEQ ID NO: 358395 - DNA, 629 bp, Homo sapiens
  misc_feature: GZ8MTXP01B9X42.9.34.D01.1.454.CMB.2.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccnttcatcatctcaganacaattcccagaacatactgtctctgcaactcaataacctgagaggcgaggacacggcctatttattctgtgcgaaaggaggcagtagtggggaaactacggtatttttcggatcccctccgctaagtccgaactactttgaattaccggtgggggacccggggtaacccgtggtccgccgtcgtcctcgacgccctaccaccgaacgggcccacgtccggttcccttcccccgtcggtccctacccctccctaccgaaacgacgccgtaccctcgtacgggggccaccgacggcccggcccgttcgggccttcgcccgtggttaccgaaacgggttacccttaaccttcccgaagtaccgttacttccgtaacgttgaacggg

SEQ ID NO: 358396 - DNA, 505 bp, Homo sapiens
  misc_feature: GZ8MTXP01B7MZO.9.34.D01.1.454.CMB.2.raw
  modified_base (440)..(440): a, c, t, g, unknown or other
  misc_feature (440)..(440): n is a, c, g, or t
  modified_base (469)..(469): a, c, t, g, unknown or other
  misc_feature (469)..(469): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagaggtcaccatctcgtgcactggaagtagctccaacatcggggcacgttatgatgtacactggtaccaacactcagacagcccccaagtcatcatttatgacaacatcgaagcggccctcgacggggtccctgcccgattccgtccggctccaagtctggcacactcacgccctccctggccatccactcgggcctccgaggcgtgaggatgagctgactatactgccngtcgtaatgacaggttgacctaagttacngttcgtctcggaacgtgggaccaggtcaaccgtccg

SEQ ID NO: 358397 - DNA, 693 bp, Homo sapiens
  misc_feature: GZ8MTXP01D7F1Y.9.34.D01.1.454.CMB.2.raw
  modified_base (192)..(192): a, c, t, g, unknown or other
  misc_feature (192)..(192): n is a, c, g, or t
  modified_base (268)..(268): a, c, t, g, unknown or other
  misc_feature (268)..(268): n is a, c, g, or t
  modified_base (322)..(322): a, c, t, g, unknown or other
  misc_feature (322)..(322): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgccgccctnagtgtcgtggggccccagggcagaggtcaccatctcgtgcactggaagtagcctaccaacagtcggggcacgttangatgtacacgtgtaccaacactcaggaaccacgaccccaaagtcatctatttancgaacaacatacgaacggccggaccctcgaccgggggtcccctaggcccgtactttcccgtaccccgggctacccgaagttcgtacggaccaacgtactaccaccggtcccctcccgtacggtaccctacgtcccgtaaccggttccggggaccctacccggtaacgggtccggtttaacggggaacggggtaagttcggggtaaacggtccttaacggtaacctttaacgtttaccgtcggtaccccgtaggttccgtaagttcgttacgtaacggttcggtaaaccttaaacgttaacgttacttacccggttaacgttaccgggtaacgtcggggacccgttaacgggtcccttaacccgggttcccg

SEQ ID NO: 358398 - DNA, 632 bp, Homo sapiens
  misc_feature: GZ8MTXP01C5G1D.9.34.D01.1.454.CMB.2.raw
  modified_base (562)..(562): a, c, t, g, unknown or other
  misc_feature (562)..(562): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtggaggggccgcttcatcatctcagagacaattcccagaacatactgtctctgacaactacaataacctgagaggcgaggacacggcctatttattctgtgacgaaggagcatagtagggaacgttacgtattttcgactcccctacgctaacgtcgactacgtttagacgtttacggcgggggaccccggggtaacccgttcgggtccgtcccgtctcctcacgccctaccaaccgaacggcccacgtccgtcccttccccggtcggcccacccctcccgtaccgaacgccgccacccgtcgtcgggggccaaccgcggcccggcccgttcgggtccncggtcccgtggttaccgaacggttaccttaaccttaccgaagtaccgtattaccgaacgttggaaccggg

SEQ ID NO: 358399 - DNA, 715 bp, Homo sapiens
  misc_feature: GZ8MTXP01BD0VE.9.34.D01.1.454.CMB.2.raw
  modified_base (191)..(191): a, c, t, g, unknown or other
  misc_feature (191)..(191): n is a, c, g, or t
  modified_base (340)..(340): a, c, t, g, unknown or other
  misc_feature (340)..(340): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctnagtgtcgtcgggccccagggcaggaggtcaccatctcgtgcacgtaggaagtagcctaccaacgagtcggggctaacggttatgatcgtacacgtaggtaacccaactaaccttccaggaaccacgacccccaaagtcatactatttanagaacaaacgatacgaacggccggtacccgtcgacgggggttacccctaggcccgtagtttccccgtccgggaccttacccgaaaggttccgtacgggaccaacctacgttacccgaccggtccccttcccggtacgggtacccctaacgttcccgaccggttcggggtcccttacccggacgggtaccgttagggaacggggtaagtcggaacggtccttaacggtaacctttaacgttaccgtacgtacccgtaggtttcggtaactaggacccgtaaggttccgggtaaacctaaacgttacgttacttccggttaacgttacgggaaccgttacggggaccttaacgggtccgttaacccggttaaccggg

SEQ ID NO: 358400 - DNA, 629 bp, Homo sapiens
  misc_feature: GZ8MTXP01CWAHT.9.34.D01.1.454.CMB.2.raw
  modified_base (233)..(233): a, c, t, g, unknown or other
  misc_feature (233)..(233): n is a, c, g, or t
  modified_base (274)..(274): a, c, t, g, unknown or other
  misc_feature (274)..(274): n is a, c, g, or t
  modified_base (369)..(369): a, c, t, g, unknown or other
  misc_feature (369)..(369): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaacttcccagaacatactgtcnctgcaactcaaataacctgagaggcgaggacacggcctatttattctgtgacgaaggagcagtagtgggaacgtacgtatttcgactccctcgcngtcgactacgttgagttacgcgggggacccgggtacctggtccgccgtctcctcgacgccctaccaccgaacggcccacgttcccggttccctttccccggcggcccctacccctccctaccgaacgcgcctaccgtcgtcgggggccaccgcggcccgggtcccgttcggggtccttcggtcccgtcgggttaaccgaacgggttacccttaaccgttacccgaacggtaccggtacttccgtaacgttcggaacgggg

SEQ ID NO: 358401 - DNA, 574 bp, Homo sapiens
  misc_feature: GZ8MTXP01DL9TW.9.34.D01.1.454.CMB.2.raw
  modified_base (246)..(246): a, c, t, g, unknown or other
  misc_feature (246)..(246): n is a, c, g, or t
  modified_base (300)..(300): a, c, t, g, unknown or other
  misc_feature (300)..(300): n is a, c, g, or t
  modified_base (316)..(316): a, c, t, g, unknown or other
  misc_feature (316)..(316): n is a, c, g, or t
  modified_base (331)..(331): a, c, t, g, unknown or other
  misc_feature (331)..(331): n is a, c, g, or t
  modified_base (388)..(388): a, c, t, g, unknown or other
  misc_feature (388)..(388): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgaggggaggactggagtgggtcncaggcatcgctggtgcggtcatgacacattctacgcaaactccgtgaggggccnttcatcatctccaganacaattcccagaacntactgtctctgcaactcaatacctgagaaggcgaaggacacgggcctatttatttcngtgcgaaggaggcagtagtggggaagtacgtattttcgatccctcgcagtcggactctttgatttacgtcgggggccgggaaccctggtccgtcccgtctcctcaacgcccttccaccgaacgggccccagttcccggttccttcccccgtggccctaaccccgtcctccaagtcgccgtaacccg

SEQ ID NO: 358402 - DNA, 596 bp, Homo sapiens
  misc_feature: GZ8MTXP01C6GUE.9.34.D01.1.454.CMB.2.raw
  modified_base (249)..(249): a, c, t, g, unknown or other
  misc_feature (249)..(249): n is a, c, g, or t
  modified_base (272)..(272): a, c, t, g, unknown or other
  misc_feature (272)..(272): n is a, c, g, or t
  modified_base (317)..(317): a, c, t, g, unknown or other
  misc_feature (317)..(317): n is a, c, g, or t
  modified_base (328)..(328): a, c, t, g, unknown or other
  misc_feature (328)..(328): n is a, c, g, or t
  modified_base (365)..(365): a, c, t, g, unknown or other
  misc_feature (365)..(365): n is a, c, g, or t
  modified_base (582)..(582): a, c, t, g, unknown or other
  misc_feature (582)..(582): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgagggccgcttcatcatctccaganacaattcccagaacatactgtcnctgcaactacaataacctgagaggcgaggacacgctatttattcngtgacgaaggngcatagtgggaactacgtattttcgactcccctcgcngtcgactactttgacttacgtcgggggacccgggacccttggtccgccgtctcctcacgccctaccaccgaacgggcccacgttccggtccccttccccggtcggccctacccctccctaccgaacgcgcctacccgtcggtcgggggccacgcggccggccgttcgggccttcgtccgtggttaccgacggttacctaacgttccaagtacgtacnctaacgttgaacgg

SEQ ID NO: 358403 - DNA, 555 bp, Homo sapiens
  misc_feature: GZ8MTXP01DQALE.9.34.D01.1.454.CMB.2.raw
  modified_base (322)..(322): a, c, t, g, unknown or other
  misc_feature (322)..(322): n is a, c, g, or t
  modified_base (512)..(512): a, c, t, g, unknown or other
  misc_feature (512)..(512): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtcgtcggggccccagggcagaggtcaccatctcgtgcactggaaagtagctccaacatcggggcacgttatgatgtacactgtaccaaacaacttccaggaacacgacccccaaagtcatcatttangaacaacatcgaagccggccctcgacggggtcccctgaacccgtattcccgtcccgggctaccaagtctacggcacatcacgtccctcccgtggcccatccacgtcgggcctccgaggctggaggactggacgctagacttaattactcgacctagtcgtaatgactaggttcgaacctaagttacgttnttccgttcgttacggaacgtcgggaccaggtccaaccgttccg

SEQ ID NO: 358404 - DNA, 618 bp, Homo sapiens
  misc_feature: GZ8MTXP01B7FU9.9.34.D01.1.454.CMB.2.raw
  modified_base (249)..(249): a, c, t, g, unknown or other
  misc_feature (249)..(249): n is a, c, g, or t
  modified_base (330)..(330): a, c, t, g, unknown or other
  misc_feature (330)..(330): n is a, c, g, or t
  modified_base (370)..(370): a, c, t, g, unknown or other
  misc_feature (370)..(370): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgagggccgcttcatcatctccaganacaattcccaagaacatactgtctctgcaactcaataacctgagaggcgaggacacggcctatttattctgtgacgaaggngacatagtgggtaaacgtacgtatttcgactccctccgcngtcgactacgtttgacgttacggtcgggggacccgggtaccgtggtccgccgtcctcctcacgccctaccaccgaacggcccacgttccggttccccttccccggtcggtcccctaccccgtccctaccgaacgaccgcctaccgtcggtcgggggaccaccggcgccggcccgttgggccttcgcccgtggttaccgaacggttcctaaccgttccaacgtacgtacttcctaacgttcggaacggg

SEQ ID NO: 358405 - DNA, 623 bp, Homo sapiens
  misc_feature: GZ8MTXP01ELUDV.9.34.D01.1.454.CMB.2.raw
  modified_base (191)..(191): a, c, t, g, unknown or other
  misc_feature (191)..(191): n is a, c, g, or t
  modified_base (266)..(266): a, c, t, g, unknown or other
  misc_feature (266)..(266): n is a, c, g, or t
  modified_base (301)..(301): a, c, t, g, unknown or other
  misc_feature (301)..(301): n is a, c, g, or t
  modified_base (325)..(325): a, c, t, g, unknown or other
  misc_feature (325)..(325): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctnagtgtctcggggccccagggcagaggtcaccatctcgtgcacgtggaagtagctccaacagtcggggcacgttangatgtacactcgtaaccaacaacttccaaggaacncgaccccaaagtcatctaatttanagaacaacatacgaacgccggaccctcgacggggtcccctagcccgtattccgcccggtctaccgtaagtcgtacggaccacactccgacgtccccttcccgacggccactccgacgtcgggcctaccgaggccgtagggacggtagtcgggacggtcctgtaaccttagtttaccgtcgacctaggttccgtaattcgaacgtaggttacggacccgtaaaagttaccttgttacccggttaacgttaccggggaacctcggggtaaacccgacgggttcccaacccggtttcccgg

SEQ ID NO: 358406 - DNA, 587 bp, Homo sapiens
  misc_feature: GZ8MTXP01CWDVH.9.34.D01.1.454.CMB.2.raw
  modified_base (304)..(304): a, c, t, g, unknown or other
  misc_feature (304)..(304): n is a, c, g, or t
  modified_base (320)..(320): a, c, t, g, unknown or other
  misc_feature (320)..(320): n is a, c, g, or t
  modified_base (374)..(374): a, c, t, g, unknown or other
  misc_feature (374)..(374): n is a, c, g, or t
  modified_base (389)..(389): a, c, t, g, unknown or other
  misc_feature (389)..(389): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagaccctatgccttgacctgggtcccgccaggctccgagggggagggactgggagtgggtcgcaggcatcgctggtggcggtcatgacacattcacgcaaactccgtgagggccnttcatcatctccaganacaattccccaagaacatactgtctctgacaacctcaaatacctgagaaggcgnggacacggctatttntctgtgcgaaggagcatagtgggaaagttacgtattttcgacttcccgcgtcagtcggactacgtttgacgttacgtcgggggcccggtaaccgtcgggtccgtccgtcctcctcaaccgcccttccaccgaacgggccccagttcccggttccttccccgtggccctaacccctcctaccaacgtcgccgtaacccg

SEQ ID NO: 358407 - DNA, 669 bp, Homo sapiens
  misc_feature: GZ8MTXP01DVYF0.9.34.D01.1.454.CMB.2.raw
  modified_base (192)..(192): a, c, t, g, unknown or other
  misc_feature (192)..(192): n is a, c, g, or t
  modified_base (335)..(335): a, c, t, g, unknown or other
  misc_feature (335)..(335): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgccgccctnagtgtcgtcggggccccagggcagacggtcaccatcgtcgtgcacgtggaagtagcctaccaacgagtcgggcacgttatgatgtacactacgtaaccaaactaactaccaaggaacacgaccccaaagtcatactaatttanacgaaacaaacagtaccgaaacggccggtcccgtacggaccgggggtcccctaggaaccccgtaactttcccgtcccgggaccttacccgtaaacgttccgtacgggacccaacgtacttaccgaccgtcccccgttcccgtacggacccctaacgtcccgtaaccggttccgggcctaccgaacggtcggtagggaacgggtagttcgggacggtcttacggtaacctttaactttaccgcgtacccgtaagtcgtaagtacgacgtggttacgaacttaaaggttacttgttccgtaacgttcggaacgtacgggacacggtccaaccgtcg

SEQ ID NO: 358408 - DNA, 555 bp, Homo sapiens
  misc_feature: GZ8MTXP01EJS1E.9.34.D01.1.454.CMB.2.raw
  modified_base (326)..(326): a, c, t, g, unknown or other
  misc_feature (326)..(326): n is a, c, g, or t
  modified_base (361)..(361): a, c, t, g, unknown or other
  misc_feature (361)..(361): n is a, c, g, or t
  modified_base (398)..(398): a, c, t, g, unknown or other
  misc_feature (398)..(398): n is a, c, g, or t
  modified_base (442)..(442): a, c, t, g, unknown or other
  misc_feature (442)..(442): n is a, c, g, or t
  modified_base (461)..(461): a, c, t, g, unknown or other
  misc_feature (461)..(461): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagcccgccctcagtcgtcgtcgggccccagggcagaggtccaccatctcgtgcacgtggaagtagctaccgaacagtcggggcacgttatgatgtacactagtaccaacaacttccagaaccacgaccccaaagtcatctatttangaacaacagtacgaagccgccctcgacgggtcccngaacccgtattccgcccgctaccgaagtctcggacanactcacgcctccctcgcctatcacgtcggctcgagcgtgaaggntcgaggctgtacttattcncgcctagtcgtaatgatacgttcgtaccttaaagaacttcgttccgtaagttccggaagttcgggacgttaacggtccgttaacccgttccggg

SEQ ID NO: 358409 - DNA, 593 bp, Homo sapiens
  misc_feature: GZ8MTXP01D7LE8.9.34.D01.1.454.CMB.2.raw
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
  modified_base (467)..(467): a, c, t, g, unknown or other
  misc_feature (467)..(467): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgaggggagggactgggagtgggtcgcaggcatcgctgggtggcggtcatgacacattcacgcaaactccgtgaggggccncttcatcatctccagagacaattcccagaacatactgtcnctgacaactcaaatacctgagaggcgaaggacacggctatttattctgtgacgaaggaggacagtagagggtaaagtacgtatttcgactcccctcgacagtcgactacgtttgacgttacggnggggcccgggaaccgtggtccgccgtctcccgtcaacgccttcccaaccgacgggccctacgttccggttcccttcccccgtcggccccaacccctcccgtacccaacgtaacgccgtaaccccgg

SEQ ID NO: 358410 - DNA, 600 bp, Homo sapiens
  misc_feature: GZ8MTXP01ENKE7.9.34.D01.1.454.CMB.2.raw
  modified_base (234)..(234): a, c, t, g, unknown or other
  misc_feature (234)..(234): n is a, c, g, or t
  modified_base (375)..(375): a, c, t, g, unknown or other
  misc_feature (375)..(375): n is a, c, g, or t
  modified_base (585)..(585): a, c, t, g, unknown or other
  misc_feature (585)..(585): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactgggagtgggtcgcaggcatcgctggtggcggtcatgacacattctacgcaaactccgtgaggggccncttcatcatctccagagacaattcccagaacatactgtctctgacaactacaataacctgagaggcgaggacacggcctatttatttctgtgacggaaggaggcatagtagggtaactacgtattttcgactccctccgcngtcgaactatttgacttacggcgggggacccgggacccgtggtccgtccgtctcctcacgtccctaccaccgacggcccacgtccggttcccttccccggtgccctacccctccctaccgaacgacgccacccgtcggtcgggggacaacgcggccggcccgttgggcttcgccgtggttacgaagggacctaacgttccgaagtcgtanctaacgttggaacgg

SEQ ID NO: 358411 - DNA, 556 bp, Homo sapiens
  misc_feature: GZ8MTXP01BJ6AQ.9.34.D01.1.454.CMB.2.raw
  modified_base (314)..(314): a, c, t, g, unknown or other
  misc_feature (314)..(314): n is a, c, g, or t
  modified_base (461)..(461): a, c, t, g, unknown or other
  misc_feature (461)..(461): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgcctcagtgtctggggccccagggcagagggtcaccatctcgtgcactggaagtagctccaacagtcggggcacgttatgatgtacactgaccaacactcaggaacacgaccccaaagtcatcatttanagaacaacatacgaacgcggaccctcgacggggtccctacgccgtacttccgtcccgggctaccgaacgtctgacacactcacgccctccgcggaccactcgactcgggctcgaggctggagactggacggctagacttattaccgngtacctaggttcgtaatgacctggttccgaccgtaaagttacttcgttccgtaacttacggaacgttcggggaccaacggtcccgaaccgtccgg

SEQ ID NO: 358412 - DNA, 671 bp, Homo sapiens
  misc_feature: GZ8MTXP01ANRR9.9.34.D01.1.454.CMB.2.raw
  modified_base (228)..(228): a, c, t, g, unknown or other
  misc_feature (228)..(228): n is a, c, g, or t
  modified_base (543)..(543): a, c, t, g, unknown or other
  misc_feature (543)..(543): n is a, c, g, or t
  modified_base (587)..(587): a, c, t, g, unknown or other
  misc_feature (587)..(587): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctgggccccagggcagaggtcaccactcgtgtncacgtaggaagtacgcctaccaactaggtcgggactacgttagtagtagttacgtaacctacgtacggtaacccaaactaccttaccgaacggaacacccgaacccccaaagtactaatacttaatttagacaacaaactagtacgaacggccgtcccgtacgggacccgggttccctacggaacccgttacttcccggtcccggtacctaccgtaacgttcgtacggacccaacgtactacgacccgtccccttccggtaccggacctactaccgtacggtcgggtccctacgggacggtcgtagggaacggtnagggacgtctagtaacttactttacgtccgacctagttcgtaancgacgtaggttccgtaaacctaaagttacgttgttccgtaacgtacggaacggttcggaacgttacggtccttaaccggtcggg

SEQ ID NO: 358413 - DNA, 535 bp, Homo sapiens
  misc_feature: GZ8MTXP01A3IFM.9.34.D01.1.454.CMB.2.raw
  modified_base (320)..(320): a, c, t, g, unknown or other
  misc_feature (320)..(320): n is a, c, g, or t
  modified_base (529)..(529): a, c, t, g, unknown or other
  misc_feature (529)..(529): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagaggtcaccatctcgtgcactggaagtagctccaacagtcggggcacgttatgatgtacactggtaaccaacaactccaggaacacgacccccaaagtcatctattangacaacatcgaacgcggcccgtcgacggggtccctgccgtactccgtccggctccgaagtctacggcacactcacgccctccctggccctatccgacgtcgggctccgaggcgtgaggatggaggctgacttatacgtcgaccagttcgtaatcgatagttcggacctaagttacttgttcgttaacgtcggaacgtgggacaggtccnccgtcg

SEQ ID NO: 358414 - DNA, 585 bp, Homo sapiens
  misc_feature: GZ8MTXP01BB7F0.9.34.D01.1.454.CMB.2.raw
  modified_base (458)..(458): a, c, t, g, unknown or other
  misc_feature (458)..(458): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccagaacacgacccccaaagtcatcatttatgaacaacatacgaacgcggccctcgacggggtcccctagaacccgtacttccgtcccgggcctaccgaagtctaggacctacactccacgccctccctcggcccaatccgacgttcgggcctccgaggccgtaggaggntggacgctgacttacttacgtgaccctagtcgtaatcgacgtagttcggtacctaaaggttacttacgttccgtaacgttaccgggaacgtcggggtacccgaacgggtcccgaacccggttcccgg

SEQ ID NO: 358415 - DNA, 614 bp, Homo sapiens
  misc_feature: GZ8MTXP01AKSJB.9.34.D01.1.454.CMB.2.raw
  modified_base (179)..(179): a, c, t, g, unknown or other
  misc_feature (179)..(179): n is a, c, g, or t
  modified_base (196)..(196): a, c, t, g, unknown or other
  misc_feature (196)..(196): n is a, c, g, or t
  modified_base (275)..(275): a, c, t, g, unknown or other
  misc_feature (275)..(275): n is a, c, g, or t
  modified_base (604)..(614): a, c, t, g, unknown or other
  misc_feature (604)..(614): n is a, c, g, or t
tcagtgatacgtctcacgaccggtgctcgatttagatcgtctgtgttgggtttgggattcacctttgagacctatgccttgacctgggtccgccaggctccaggggagggactggagtgggtcgcaggcatcgctggtggcggtcatgacacattctacacaaactccgtgaggggccncttcatcatctccaganacaattcccagaacatactgtctctgcaactcaataacctgagaggcgaggacacggcctatttattctgtgcgaaggnggcatagtgggaagtacgtatttcgactcccctccgcagtcactactttgacgttacgtcgggggcccgggaacccgtcggtccgcccccgtctcctcacgccctacccaccgaacgggccctacgtccgggttcccttccccccgtgggcccctaccccctccctacccaaacgacgcccgtacccgtcgggtcgggggaccaacgcggcccggcccgtgggcctcggcccgggttcgggtaccaaacgggtaccttaccgttccgagtaaccgtagttcccaacgtcggacgggtcgggaacgtcgggacaacgggccgctaattgnnnnnnnnnnn

SEQ ID NO: 358416 - DNA, 567 bp, Homo sapiens
  misc_feature: GZ8MTXP01EFCHL.9.34.D01.1.454.CMB.2.raw
  modified_base (232)..(232): a, c, t, g, unknown or other
  misc_feature (232)..(232): n is a, c, g, or t
  modified_base (272)..(272): a, c, t, g, unknown or other
  misc_feature (272)..(272): n is a, c, g, or t
  modified_base (369)..(369): a, c, t, g, unknown or other
  misc_feature (369)..(369): n is a, c, g, or t
  modified_base (419)..(419): a, c, t, g, unknown or other
  misc_feature (419)..(419): n is a, c, g, or t
  modified_base (506)..(506): a, c, t, g, unknown or other
  misc_feature (506)..(506): n is a, c, g, or t
  modified_base (522)..(522): a, c, t, g, unknown or other
  misc_feature (522)..(522): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtcnctgcaactacaataaacctgagaggacgaggacacggcctatttatttctgtgcgaaggaggcatagtggaagtacgtattttcgatccctaccgcngtcgacactttgattacgtggggacccggggaccctggtcgccgtctccncacgccctccaccaacgggcccctatccggtccttccccgtcggccctacccctcctaccaacgacgcaccctcgtgggggccacgngccgcccgttgggccngcccgtgttcgaggactaacttccaagtacgattcaacgttgcgg

SEQ ID NO: 358417 - DNA, 605 bp, Homo sapiens
  misc_feature: GZ8MTXP01CDNTM.9.34.D01.1.454.CMB.2.raw
  modified_base (232)..(232): a, c, t, g, unknown or other
  misc_feature (232)..(232): n is a, c, g, or t
  modified_base (367)..(367): a, c, t, g, unknown or other
  misc_feature (367)..(367): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgagggccncttcatcatctccagagacaattcccagaacatactgtctctgcaactcaataacctgagagcgaggacacggctatttattctgtgacgaaggagcagtagtagggaagttacgtattttcgactccctacgcngtcgactactttgacttacggtcgggggacccgggtacccgtggtccgcccgtctcctcacgcctccaccgaacggcccagtccgtcccttcccccgtcggccctacccctaccctacccaaacgccgaccgtacccgtccggtcgggggccaccgcggcccggcccgttcgggccttcgtccgtggttaccgacggttacctaaccttccgaagtacgtcttactcgttggaacggg

SEQ ID NO: 358418 - DNA, 614 bp, Homo sapiens
  misc_feature: GZ8MTXP01BM78X.9.34.D01.1.454.CMB.2.raw
  modified_base (232)..(232): a, c, t, g, unknown or other
  misc_feature (232)..(232): n is a, c, g, or t
  modified_base (373)..(373): a, c, t, g, unknown or other
  misc_feature (373)..(373): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggaacacggcctatttattctgtgacgaaggaggcagtagtagggaaacgtacgtattttccgattcccctcgcngtcgactactttgacttacgcgggggacccgggtaacccgtggtccgtccgtctccgtcacgtccctacccacccgaacgggccccacgtccggtcccttcccccggtcggtccctacccctccctaccaacgacgccacccgtcgtcgggggcaccgcggccggcccgttgggccttcggtacgtcggttacgaacgttacctaacttccgaagtacgtacttcgtaacgttggaacggg

SEQ ID NO: 358419 - DNA, 654 bp, Homo sapiens
  misc_feature: GZ8MTXP01DFYUF.9.34.D01.1.454.CMB.2.raw
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (357)..(357): a, c, t, g, unknown or other
  misc_feature (357)..(357): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagaggtcaccatctcgtgcactggaaagtagctccaacatcggggcacgttatgatgtacactgtaccaaacacttccaggaacacgccccaaagtcatcatttangacanatgaagcgccctcgacggggtccctgccgattccnccggctaccaagtctagcacatcacgcctccctaggccctaatccacgtcggggcctaccgagggtccgtaggaaggtacgttgggaacggccttggtaacctttaaactttaccgtggaccccgtagttcccggttaaagttggaaacccgtaagggtttcgggtaaacccgtttaaaacgggttaaaaacccttcgtttacccgggttaacccgttttaaaccgggggaaacccgtttacggggggaaaccccttaaaacgggggttccccttaaaccccggggttttccccggg

SEQ ID NO: 358420 - DNA, 599 bp, Homo sapiens
  misc_feature: GZ8MTXP01EUTNP.9.34.D01.1.454.CMB.2.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggcccgccaggctccaggggagggactggagtgggtcgcaggcatcgctggtggcggtcatgacacattctacgcaaactccgtgagggccgcttcatcatctccagagacaattcccaagaacatactgtctctgacaactacaataaacctgagaggcgaggacacggctatttatttctgtgacgaaggagcatagtagggaactacgtattttcgactcccctcgactaagtcgactactttgatttacggcgggggacccgggaccctggtccgccgtctcctcacgcctccaaccgacgggcccagtccggtcccttccccggtcgcccaccccgtccaccaagacgccacccgtcggtcgggggaccacgcggccggcccgttggggccttcggcccgtggacgaacggttaccttaaccgttccaacgtacgtacttcaacgttggaacggg

SEQ ID NO: 358421 - DNA, 594 bp, Homo sapiens
  misc_feature: GZ8MTXP01BEZ7E.9.34.D01.1.454.CMB.2.raw
  modified_base (321)..(321): a, c, t, g, unknown or other
  misc_feature (321)..(321): n is a, c, g, or t
  modified_base (352)..(352): a, c, t, g, unknown or other
  misc_feature (352)..(352): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagaggtcaccatctcgtgcactggaagtagctccaacgatcggggcacgttatgatgtacactggtaccaacaacttccaaggaacacgacccccaaagtcatcatttangacaacatcgaagcgccctcgacgggtcccngccgtattccgtccggctccaagtctcggcacactcacgccctcccgtcggcctatccacgtcgggtcctccgacggcgtggaagggataggaggtctcgtaacttacttactcgacctaggttcgtaatcggacgtacggttcgggtaaacctaaagttaaccgttacgttccggttaaccgttaccgggaaccgttcgggggaacccgttaaacgggttccccgaacccgggtttcccgg

SEQ ID NO: 358422 - DNA, 645 bp, Homo sapiens
  misc_feature: GZ8MTXP01DES87.9.34.D01.1.454.CMB.2.raw
  modified_base (322)..(322): a, c, t, g, unknown or other
  misc_feature (322)..(322): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtcgtcggggccccagggcagagggtcaccatctcgtgcacgtggaaagtacgctaccaacagtcggggcacgttatgatgtacactgaccaacactcaggaacacgaccccaaagtcatacatttanagaacaacatcgaacgcggccctcgacggggtcccctagccgtacttccgcccggctaccgaagtctcggacacactcacgtccctcccgtcggcctatccgacgttcgggaccttaccgacggtccggtaggacggtagtacggacggtcgttacgtaactttacgttaccgtacgtacccgtagttacgtaacgtcggaaacgtacgggttacgtaaacccgttaaagttaaaccgttacgtttaccggttaaccggttaaccgggtaaccggttaacggggtaacccgttaaacggttcccggttaacccgtttcccggg

SEQ ID NO: 358423 - DNA, 599 bp, Homo sapiens
  misc_feature: GZ8MTXP01ELNWL.9.34.D01.1.454.CMB.2.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtcgtgggccccagggcaggaggtcaccatctcgtgcacgtggaagtacgctaccaacagtcgggcacgttatgatgtacactacggtaaccaaacaactccaaggaacacgaccccaaagtcatctattatagaacaacatacgaacgcgcctcgacgggtcccagctatccgccgctaccagtctgacacactcacgtccctccgtacgcctactcgacgtcggcctcgacggtcgtaggagtagtacggagtactacgtaacttaacgtttccgcggtacccgtaggttacgtaacgtacgacgtacggttccggtaaaccttaaacggttacttcgttaccggttccggttacggaaccgttacgggaaccgttaccggttccgttaacccggttcccggg

SEQ ID NO: 358424 - DNA, 588 bp, Homo sapiens
  misc_feature: GZ8MTXP01ETYZY.9.34.D01.1.454.CMB.2.raw
  modified_base (215)..(215): a, c, t, g, unknown or other
  misc_feature (215)..(215): n is a, c, g, or t
  modified_base (323)..(323): a, c, t, g, unknown or other
  misc_feature (323)..(323): n is a, c, g, or t
  modified_base (396)..(396): a, c, t, g, unknown or other
  misc_feature (396)..(396): n is a, c, g, or t
  modified_base (504)..(504): a, c, t, g, unknown or other
  misc_feature (504)..(504): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtcccnccaggctccgagggggagggactgggagtgggtcgcaggcatcgctgggtggcggtcatgacacattcacgcaaactccgtgacggggccgcttcatcatctccaganacaattcccagaacatactgtctctgcaacctcaaataacctgagaaggcgaaggacacggcctatttattcngtgacgaaggaggcatagtagggtaagtacgtatttcgactccctcgacacgtcggactacgtttggtacgtcggggcccgggaccgtgggtccgtccgtctccgtcncgccctaccgaccgaacgggccctacgtcccggttcccttccccgcggccctacccctcctaccacgacgtccttaaccgtcgg

SEQ ID NO: 358425 - DNA, 583 bp, Homo sapiens
  misc_feature: GZ8MTXP01EKO06.9.34.D01.1.454.CMB.2.raw
  modified_base (318)..(318): a, c, t, g, unknown or other
  misc_feature (318)..(318): n is a, c, g, or t
  modified_base (392)..(392): a, c, t, g, unknown or other
  misc_feature (392)..(392): n is a, c, g, or t
  modified_base (545)..(545): a, c, t, g, unknown or other
  misc_feature (545)..(545): n is a, c, g, or t
  modified_base (562)..(562): a, c, t, g, unknown or other
  misc_feature (562)..(562): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccgcttcatcatctccaganacaattcccagaacatactgtctctgcaactcaaatacctgagaaggcgaaggacacgggcctattttatttcngtgacgaaggaggcatagtgggaaagtacgtatttcgattcccgtcgcagtcggactacgtttgagttacgtcggggccgggtaacctggtcgtccgtctcctcaacgcccttccaccgaaacgggccctacgttccggttcctttcccccgnggacccaacccttcccnccaacgtaacgccgtaacccg

SEQ ID NO: 358426 - DNA, 746 bp, Homo sapiens
  misc_feature: GZ8MTXP01CMM6Q.9.34.D01.1.454.CMB.2.raw
  modified_base (206)..(206): a, c, t, g, unknown or other
  misc_feature (206)..(206): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacanattctacgcaaactccgtggaggggccgcttcatcatctccagagacaattcccagaacatactgtctctgacaactcaataacctgagaggcgaggacacggcctatttattctgtgacggaaggagcatagtagggaacgtacgtattttcgactccccgtaccgcaacgtcgtactacgttttgacgtttaccgggtcggggggtaccccggggtaacccgttcgggtcccggtcccggttcctcccgttccgaccggtccccttaccccgaacccggtaaccggggtacccccgtaaccggttccccggggttaccccctttcccccccggggttcccgggtaccccgtaccccccttaccccgttaccccgtaaaccggtacccggacccgtaaccccggtccggttaccgggggggacccaccggaccgggtcccgggccccggttcggggcccgttcggtcccgtcgggttaccgaacgggttacccttaaccgttaccgaacgtacgtacttaccgtaacgttcggaacggg

SEQ ID NO: 358427 - DNA, 571 bp, Homo sapiens
  misc_feature: GZ8MTXP01CZPPM.9.34.D01.1.454.CMB.2.raw
  modified_base (179)..(179): a, c, t, g, unknown or other
  misc_feature (179)..(179): n is a, c, g, or t
  modified_base (363)..(363): a, c, t, g, unknown or other
  misc_feature (363)..(363): n is a, c, g, or t
  modified_base (403)..(403): a, c, t, g, unknown or other
  misc_feature (403)..(403): n is a, c, g, or t
  modified_base (561)..(571): a, c, t, g, unknown or other
  misc_feature (561)..(571): n is a, c, g, or t
tcagtgatacgtctcacgaccggtgctcgatttagatcgtctgtgttgggtttgggattcacctttgagacctatgccttgacctgggtccgccaggctccaggggagggactggagtgggtcgcaggcatcgctggtggcggtcatgacacattctacacaaactccgtgaggggccncttcatcatctccagagacaattcccagaacatactgtctctgcaactcaataacctgagaggcgaggacacggcctatttattctgtgcgaaggaggcatagtgggaagtacgattttcgatccctccgcagtcgacactttgattacgtgggggccgggaacctggtccgccccgtctcctnacgccctaccaccaacgggcccatccgggtccttcccccnggccacccctcctcaacgcgcaccctcgtgggggccacgaggcccggccccgtggggcctcggcccgttcgggtacgaacgggtacccttacgttcccgagtaccggttaatccgaacgtcggacgggcgggcgtcgggacgaagggcgacgattagnnnnnnnnnnn

SEQ ID NO: 358428 - DNA, 616 bp, Homo sapiens
  misc_feature: GZ8MTXP01AKVPY.9.34.D01.1.454.CMB.2.raw
  modified_base (324)..(324): a, c, t, g, unknown or other
  misc_feature (324)..(324): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctcggggccccagggcagaggtcaccatctcgtgcactggaagtacgctaccaacagtcggggcacgttatgatgtacactcggtaccaacaacttccaaggaacacgaccccaaagtcatcatttanagacaacatcgaacgcggccctcgacggggtccctacgcccgtattccgtcccggctaccgaagtctggaccacatcacgccctcccgtcggccacgtccacgttcgggcctccgagggtacgtggaacggtgtacgggacgtcgtagtacttaacgtttacctcggtacctaaggttccgtaagtcgaacgtaggttacggtaaccctaaacggttaccttcttacccggttcgtttaccgggaaccgtacggggtaacccgttaacgggtcccgttaaccccggttccgg

SEQ ID NO: 358429 - DNA, 648 bp, Homo sapiens
  misc_feature: GZ8MTXP01CV9D3.9.34.D01.1.454.CMB.2.raw
  modified_base (192)..(192): a, c, t, g, unknown or other
  misc_feature (192)..(192): n is a, c, g, or t
  modified_base (333)..(333): a, c, t, g, unknown or other
  misc_feature (333)..(333): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgccgccctnagtgtctcggggccccagggcaggacggtcacatctcgtgcacgtggaaagtagcctacaacgagtcgggcacgtatgatagtacactacggtaccaaactaacttaccaggaaaccacgaccccaaagtcaatcatttanacgaacaacatacgacgcggccctcggacggtaccctacggaacccgtattcccgtacccggtcctaccgaacgtcgtacggaccaacactccgaccgtccccttacccgcggaccctaatccgaaccgttcgggccttaccgacggtcgtaggaggtactagggaacggtctacgtacttacttaacgtccgaccgtagtcgttaacgcgttaacgtagttccggtaaaccgttaaggttaaacttcgttaccggttaacggtaccggtaacgttccggggaaccttacgggtcccgttcccggttaacccggg

SEQ ID NO: 358430 - DNA, 587 bp, Homo sapiens
  misc_feature: GZ8MTXP01AYD75.9.34.D01.1.454.CMB.2.raw
  modified_base (179)..(179): a, c, t, g, unknown or other
  misc_feature (179)..(179): n is a, c, g, or t
  modified_base (265)..(265): a, c, t, g, unknown or other
  misc_feature (265)..(265): n is a, c, g, or t
  modified_base (574)..(574): a, c, t, g, unknown or other
  misc_feature (574)..(574): n is a, c, g, or t
  modified_base (577)..(587): a, c, t, g, unknown or other
  misc_feature (577)..(587): n is a, c, g, or t
tcagtgatacgtctcacgaccggtgctcgatttagatcgtctgtgttgggtttgggattcacctttgagacctatgccttgacctgggtccgccaggctccaggggagggactggagtgggtcgcaggcatcgctggtggcggtcatgacacattctacacaaactccgtgaggggccncttcatcatctccagagacaattcccagaacatactgtctctgcaactcaaatacctgagaggcgaggacacggcctatttattcngtgcgaaaggaggcatagtgggaaagtacgtagtttttcgactcccctcggcagtcgactactttgatttacggcgggggcccgggaacctggtccgccccgttctccgtcacgccctaacccgaaccaacgggcccctagtccgggtcccctttccccccgtgggcccctaccctccctaccgaaacgtacgcctacccgtcggtcgggggccacgcggcccggccccgtgggcctcggccgtggaccgaaagggccttaccgtcccgagtactatccacgtggacggcggctggcgaaggcgactanagnnnnnnnnnnn

SEQ ID NO: 358431 - DNA, 640 bp, Homo sapiens
  misc_feature: GZ8MTXP01BVKU0.9.34.D01.1.454.CMB.2.raw
  modified_base (338)..(338): a, c, t, g, unknown or other
  misc_feature (338)..(338): n is a, c, g, or t
tcagtgatacgtctcacgaccggtgctcgatttagatcgtctgtgttgggtttgggggctctgcttcagctgtgggcacaagaggcagcactcaggacaatctccagcatggcctgtctctctcctcctcactctcctcgctcactgcacagggtcctgggcccagtctgttctgacgcacgccgccctcagtgtccgtcggggccccagggcagacggtcaccatctcgtgcacgtggaaagtacgctaccaacgtagtcggggctacgttatgatgtacactacggtaaccaaacaactaccaaggaaccacgaccccaaagtcattactatttanacgaacaacatacgaacgcggccctcgacgggtccctagccgtacgttccgccggctaccgtaacgtctacgcacactcgacgtcccttcccgtacggacctacgtccgaccgtcgggtccttcgtcgggaccggttaggaagggtaactgggtaacggtcttacggtaactttacgttacgcgtaccgtaggttccgtaagtcgacgtacggttacggtaaccgtaaagttaaccgttcgttacgttaacgtacgggtaaccgttacgggaacccgttaacggtccgttccggttaaccgg

SEQ ID NO: 358432 - DNA, 623 bp, Homo sapiens
  misc_feature: GZ8MTXP01EVPUE.9.34.D01.1.454.CMB.2.raw
  modified_base (215)..(215): a, c, t, g, unknown or other
  misc_feature (215)..(215): n is a, c, g, or t
  modified_base (305)..(305): a, c, t, g, unknown or other
  misc_feature (305)..(305): n is a, c, g, or t
  modified_base (321)..(321): a, c, t, g, unknown or other
  misc_feature (321)..(321): n is a, c, g, or t
  modified_base (407)..(407): a, c, t, g, unknown or other
  misc_feature (407)..(407): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtcgtgggggaggcttggtccagcctggggagtccctgcgactctcctgtgtggcctctggattcacctttgagacctatgccttgacctgggtccnccaggctccgagggggaggactggagtgggtcgcaggcatcgctgggtggcggtcatgacacattctacgcaaactccgtggacgggccncttcatcatctcaganacaattcccaagaacatactgtctctgaccaaacctcaaataaccgtgaacgaagggcgaaggacaccgggtcctattttatttcngtcgacgaaggaggacaagtagtagggtaaagttacgtatttcgacttcccctcgcacgtcggactactttgacgttacggcggggcccgggtaaccgtcggtccgtccgtcctcctcaacgtcccttccgacccgacgggcccctacgttcccggttccccttcccccgtcggcccctaaccccgttcccacccgaacgtccgcccgtaacccgg

SEQ ID NO: 358433 - DNA, 584 bp, Homo sapiens
  misc_feature: GZ8MTXP01A3HN8.9.34.D01.1.454.CMB.2.raw
  modified_base (232)..(232): a, c, t, g, unknown or other
  misc_feature (232)..(232): n is a, c, g, or t
  modified_base (364)..(364): a, c, t, g, unknown or other
  misc_feature (364)..(364): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgagggccncttcatcatctccagagacaacttcccagaacatactgtctctgcaactcaatacctgagaggcgagacacggctatttattctgtgcgaaggagcatagtagggaacgtacgtattttcgactccctcgcngtcgactactttgattacggtcgggggacccgggaccgtggtccgccgtctcctcacgccctccaccgacggcccacgtccgtcccttccccggtcggccctacccctccctaccaacgcgccaccgtcgtcggggccacgcgccggcccgttgggccttcgccgtcggttacgacggttacctaaccttccaagtacgtacttcaacgttcggaacggg

SEQ ID NO: 358434 - DNA, 643 bp, Homo sapiens
  misc_feature: GZ8MTXP01EX3C9.9.34.D01.1.454.CMB.2.raw
  modified_base (337)..(337): a, c, t, g, unknown or other
  misc_feature (337)..(337): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgccgccctcagtcgtcgcggggccccagggcaggacggtcaccatcgtcgtgcacgtaggaagtacgctaccaacagtcggggctacgttatgatgtacacgtacggtaccaaacaacttccaggaaccacgaccccaaagtcatactatttanacgaacaaacatacgaacgcgaccctcgacggggtccctcgccgtacttccgccgctaccaagtctacggacagctacgacgtcccttcccgtcgcctactccgacgtcgggcctacgacggcgtaggacggtaatcggaacggtcgtacgtaacttaacgttaccgtacgacccgttaaggttccggtaattacggaccgttaagggttcgtaacccgttaaaggttaaacccttcggttccggttaaccggttacggaaccggttaccggggaaccgaacggtccgttaacccgggttcccggg

SEQ ID NO: 358435 - DNA, 571 bp, Homo sapiens
  misc_feature: GZ8MTXP01BVS0L.9.34.D01.1.454.CMB.2.raw
  modified_base (309)..(309): a, c, t, g, unknown or other
  misc_feature (309)..(309): n is a, c, g, or t
  modified_base (343)..(343): a, c, t, g, unknown or other
  misc_feature (343)..(343): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctgggccccagggcagagggtcaccatctcgtgcactggaagtagctccaacatcggggcacgtatgatgtacactgtaccaacactcagaacacgaccccaagtcatcattanagacaacatacgaacgcgccctcgacgggtcccngaaccgtattccacccggctaccgaacgtctcggcaacatccacgcccctccgtcggcccatcacgttgggcctcgacggtcgtaggaggacgtggacggcttagacttaagttacctggaccctagttccgtaagttcgacgtagttacggtacctaaagttaccagttccgttaacgttaccggaacgttacgggacccttaaagggtcccgttaaccggttccgg

SEQ ID NO: 358436 - DNA, 606 bp, Homo sapiens
  misc_feature: GZ8MTXP01CCSR1.9.34.D01.1.454.CMB.2.raw
  modified_base (232)..(232): a, c, t, g, unknown or other
  misc_feature (232)..(232): n is a, c, g, or t
  modified_base (272)..(272): a, c, t, g, unknown or other
  misc_feature (272)..(272): n is a, c, g, or t
  modified_base (361)..(361): a, c, t, g, unknown or other
  misc_feature (361)..(361): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtcnctgcaactcaataacctgagaggcgagacacggccatttattctgtgcgaaggaggcatatgggaactacggattttcgatccctcgcngtcgactactttgattacgtggggcccgggtacctggtccgcgtctcctcacgccctcaccgaacgggcccagtccggtcccttccccggtgcccaccctccctacgaacgcgcctaccgtcggtcggggccaaccgcggcccggtcccgcgggggtccttcggtcccgtacgggttaccgaaacggggttacccttaaccgttcccctaaggaccgttacttaccgtaaccgttggaacccggg

SEQ ID NO: 358437 - DNA, 586 bp, Homo sapiens
  misc_feature: GZ8MTXP01AEG1P.9.34.D01.1.454.CMB.2.raw
  modified_base (232)..(232): a, c, t, g, unknown or other
  misc_feature (232)..(232): n is a, c, g, or t
  modified_base (272)..(272): a, c, t, g, unknown or other
  misc_feature (272)..(272): n is a, c, g, or t
  modified_base (370)..(370): a, c, t, g, unknown or other
  misc_feature (370)..(370): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtcnctgcaactcaataacctgagaggcgaggacacggcctatttatttctgtgcgaaggaggcatagtgggaacgtacgtattttcgactcccctaccgcngtcgactactttgattacgtgggggcccgggaaccctggtccgccgtctcctcacgcctccaccgaacgggcccacgtccggtcccttcccccgtcggcccaccctcccgtccaacgacgccacctcgtcgggggcacgcgccggcccgttggggcttcgccgtggttcgaacggttactaaccttccgaacgtacgtacttcaacgttggaacgg

SEQ ID NO: 358438 - DNA, 675 bp, Homo sapiens
  misc_feature: GZ8MTXP01A8JE8.9.34.D01.1.454.CMB.2.raw
  modified_base (231)..(231): a, c, t, g, unknown or other
  misc_feature (231)..(231): n is a, c, g, or t
  modified_base (247)..(247): a, c, t, g, unknown or other
  misc_feature (247)..(247): n is a, c, g, or t
  modified_base (270)..(270): a, c, t, g, unknown or other
  misc_feature (270)..(270): n is a, c, g, or t
  modified_base (366)..(366): a, c, t, g, unknown or other
  misc_feature (366)..(366): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccncttcatcatctcaganacaattcccagaacatactgtcnctgcaactcaaactaacctgagaggcgaggacacggcctatttattctgtgcggaaggagcaatagtgggaatcgtattttcgactccccgtcgcngtcgaactacgtttgaagtttaccggtcggggggaccccggggtaacccgtcgggttccggtcccggtccttcccgtacgtaccggtccccttacccgaacccgtaaaccgggcccctaacgttccggttccccgttcccccggtcggccctaacccccttccccgtacccaaacggaccgaccgtacccgttccggtcggggggccaccggacggccgggtccccgttggggccttcggcccgtcggttaccgaacgggttacctaaccgttaccgaacgtacggtacttccgaaccgttgaacgggg

SEQ ID NO: 358439 - DNA, 508 bp, Homo sapiens
  misc_feature: GZ8MTXP01B37UJ.9.34.D01.1.454.CMB.2.raw
  modified_base (251)..(251): a, c, t, g, unknown or other
  misc_feature (251)..(251): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (324)..(324): a, c, t, g, unknown or other
  misc_feature (324)..(324): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
  modified_base (363)..(364): a, c, t, g, unknown or other
  misc_feature (363)..(364): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (372)..(372): a, c, t, g, unknown or other
  misc_feature (372)..(372): n is a, c, g, or t
  modified_base (374)..(374): a, c, t, g, unknown or other
  misc_feature (374)..(374): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
  modified_base (401)..(401): a, c, t, g, unknown or other
  misc_feature (401)..(401): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctcggggccccagggcaggaggtcaccatctcgtgcactggaagtagctaccaacngtcggggcacgttatgatgtacactgtaaccaacaactcagaacacgtacccaaagtcatctattananacananacgacgcgcngacggtccngctctcncgctacagtcnncacncncncnccnccncgcacncacgcgcacgagcgngagagagacgcgtacgtactactactcgacgtacgtgtaagtagacgtacgttacgtactaacttacgcttcgtaacgtacgtaacgacggacgacgtccgccgtcg

SEQ ID NO: 358440 - DNA, 589 bp, Homo sapiens
  misc_feature: GZ8MTXP01AL97G.9.34.D01.1.454.CMB.2.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgcctcagtgtctggggccccagggcagaggtcaccatctcgtgcactggaagtagctccaacatcggggcacgttatgatgtacactgtaccaacacttccaggaacacgaccccaaagtcatctatttatgaactaacatacgaacgcggaccctcgacggggtccctcggcccgtattccgtccggcttaccaagtctcggcacactcgacgtcccctacccgtggcctaacgtccacgtcgggcctaccgagggccgtaggaaggtatcggaaggtctagacctttaattaccgtcgcccgtaagttcgtaagttcgaacgtaggttcggtaaccttaaagttacacgttccgtcgttacgggaacgttcgggaacccgaacggttccgaaccggttccgg

SEQ ID NO: 358441 - DNA, 643 bp, Homo sapiens
  misc_feature: GZ8MTXP01DCLOY.9.34.D01.1.454.CMB.2.raw
  modified_base (191)..(191): a, c, t, g, unknown or other
  misc_feature (191)..(191): n is a, c, g, or t
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctnagtgtctcgggccccagggcagaggtcacatctcgtgcacgtggaagtagctccaacgagtcgggcacgttatgatgtacactagtacaactactcagaacacgaccccaaagtcatcattanagaacanatacgaacgcgccgtcgacggggtaccctagaaccgtacttcccgtcccgacctaccgaacgttcgtacggacctactacttaccgaccgtcccttaccccgtacggaccctacgttacccaccgttccgggaccttacccgaacgggtccggttaacggtaagggtaaccgttagggacggtacccgttaggtaacctttaacgttaccgtacgtacccgtacgttacgtaacgtacggacgtacggttacggtaaccctaagttacgacgttccgtaacgttacggaacgtcgggaccttacggtccgaacccgttccgg

SEQ ID NO: 358442 - DNA, 627 bp, Homo sapiens
  misc_feature: GZ8MTXP01BG52E.9.34.D01.1.454.CMB.2.raw
  modified_base (233)..(233): a, c, t, g, unknown or other
  misc_feature (233)..(233): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggcctatttattctgtgacggaaggaggacagtagtggggtaaacgtacgtatttttcgacttccccgtaccgcaacgtcgtaactacgtttgtacgtttacgggtcggggggacccgggtaacccgtgggtccgtccgtctcctcacgtcctaccaccgaacggcccacgtccgtcccttccccgtcggccctaccctccctaccacgacgcctaccgtcgtcggggccacggcgccggtccgttcggggccttcggcccgtggttaccgaacggcccttaaccgttccgaacggtacctacgacgtggaacgggtccggg

SEQ ID NO: 358443 - DNA, 632 bp, Homo sapiens
  misc_feature: GZ8MTXP01C9RVB.9.34.D01.1.454.CMB.2.raw
  modified_base (336)..(336): a, c, t, g, unknown or other
  misc_feature (336)..(336): n is a, c, g, or t
  modified_base (365)..(365): a, c, t, g, unknown or other
  misc_feature (365)..(365): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgccgccctcagtgtctgggccccagggcaggacgggtcaccatctcgtgcacgtggaaagtagctccaacgagtcggggcacgttatgatgtacactacggtaccaaacactccaaggaaccacgaccccaaagtcatacatttatgaacaanatacgaacgcgccctcgacggggtacccncgaacctacttcaccggctacccaagttcacggactacgactcacgtccctcccgtggacctatccgacgttcgggcctaccgagggcgttaggaacggagtacggacggtcctaggtaccgttaatttaccgtcggtacctacggttcgtaagttcggaaccgtaaggttacggtaacccttaaagttaaccgttacgttaccggttaacgtttaaccgggaaacgttcggggaaccttaacgggtcccgttaacccggtttcccg

SEQ ID NO: 358444 - DNA, 679 bp, Homo sapiens
  misc_feature: GZ8MTXP01ALTK0.9.34.D01.1.454.CMB.2.raw
  modified_base (333)..(333): a, c, t, g, unknown or other
  misc_feature (333)..(333): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgccgccctcagtgtccgtcggggccccagggcaggacggtcaccatctcgtgcacgtggaagtagcctaccaacagtcggggctacgttatgatgtacacgtagtaaccaaactaactacaagaacacgaccccaaagtcatctatttanagacaacatacgaacgcggcccgtcgacggggtcccaaaacgccgtacttccgtcccggcctaccgtaagtcgtacggactacacgtcacgtccctcccgtagaccctactccgacgttcgggacctaccgacggacggtaggaaggtacgtacggaacggtcctaacggtaacctttaacgtttaccgtacgtacccgtaacggttcgttaacgtacgttaaacgtacggttaccgggtaaacccttaaagttaaccgttacgtttacccggttaaccgttaacgggtaaccggttaacggggaacccgttaaccgggtaacccgttaacccggtttaacccggg

SEQ ID NO: 358445 - DNA, 633 bp, Homo sapiens
  misc_feature: GZ8MTXP01DJIZI.9.34.D01.1.454.CMB.2.raw
  modified_base (232)..(232): a, c, t, g, unknown or other
  misc_feature (232)..(232): n is a, c, g, or t
  modified_base (370)..(370): a, c, t, g, unknown or other
  misc_feature (370)..(370): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaaactcaaataacctgagaggcgaggacacggcctatttatttctgtgcgaaggaggcatatgggaaacgtacgtattttcgatccctaccgcngtcgactacttttgattacgtcgggggcccgggaaccctggtcgccgtctcctcacgcctccaaccaacggcccagtccggtccttcccccgtggcccaacccctcctacccaaagcgcctaacccgtcgtcggggggccacgacggcccgggtccccgttgggggtccttacggtccccgttgggttcccgaaaacggggttaccctttaaccgtttaccccgaaggtaaccggttacgttaccaaccgttgggaaccgggg

SEQ ID NO: 358446 - DNA, 454 bp, Homo sapiens
  misc_feature: GZ8MTXP01DQLFF.9.34.D01.1.454.CMB.2.raw
  modified_base (316)..(316): a, c, t, g, unknown or other
  misc_feature (316)..(316): n is a, c, g, or t
  modified_base (328)..(328): a, c, t, g, unknown or other
  misc_feature (328)..(328): n is a, c, g, or t
  modified_base (385)..(385): a, c, t, g, unknown or other
  misc_feature (385)..(385): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (447)..(454): a, c, t, g, unknown or other
  misc_feature (447)..(454): n is a, c, g, or t
tcagtgatacgtctcacgaccggtgctcgatttagatcgtctgtgtttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccattctccggctccaagtctggcacatcagcctcctggccatcactgggctccaggctgagatgaggctgactatactgccagtcgtatgacngtgactagtacntcgtctacggactgggaccaaggtcaaccgtctgggtcacgacccacgcccaacccntctcacttctcgttcccaccctctacagactactcactgagcgggctcggacaggcgnangnnnnnnnn

SEQ ID NO: 358447 - DNA, 602 bp, Homo sapiens
  misc_feature: GZ8MTXP01BC44I.9.34.D01.1.454.CMB.2.raw
  modified_base (370)..(370): a, c, t, g, unknown or other
  misc_feature (370)..(370): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaacttcccagaacatactgtctctgacaactcaataacctgagaggcgaggacacggcctatttattctgtggacgaaggagcaatagtgggaacgtacgtattttcgactccctcgcngtcgactactttgtacttacggtcgggggacccggggaccgtcgggtcgtcccgtctccctcgacgccctaccgaaccgaacgggcccagttccgggtcccttcccccggtcggacccaccccttcccaccgaaacgcgaccaccgtcggtcggggcaccgcggccggccgttgggcttcgcctcggttacgaggttacctcttacgaacgtacgacttcgtcgttggcggg

SEQ ID NO: 358448 - DNA, 604 bp, Homo sapiens
  misc_feature: GZ8MTXP01AJCC2.9.34.D01.1.454.CMB.2.raw
  modified_base (233)..(233): a, c, t, g, unknown or other
  misc_feature (233)..(233): n is a, c, g, or t
  modified_base (273)..(273): a, c, t, g, unknown or other
  misc_feature (273)..(273): n is a, c, g, or t
  modified_base (370)..(370): a, c, t, g, unknown or other
  misc_feature (370)..(370): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccagaacatactgtcnctgcaactcaatacctgagaggcgaggacacggcctatttattctgtgcgaaggaggcatagtagggaaacgttacgtattttcgactccctccgcngtcgaactactttgacgtttacgtcggggacccgggaaccctggtccgccgtctcctcacgcctccaccgacgggccctactccggtcctccccgtcgccctaccctcctccaacgcgcctaccgtcgtcgggggccacgacggcccggcccgttcgggccttcggcccgtcggttacgaacggttacctaacgttacccgaacgtaccgtacttccgtaacgttcggaacggg

SEQ ID NO: 358449 - DNA, 573 bp, Homo sapiens
  misc_feature: GZ8MTXP01EVGSN.9.34.D01.1.454.CMB.2.raw
  modified_base (233)..(233): a, c, t, g, unknown or other
  misc_feature (233)..(233): n is a, c, g, or t
  modified_base (273)..(273): a, c, t, g, unknown or other
  misc_feature (273)..(273): n is a, c, g, or t
  modified_base (327)..(327): a, c, t, g, unknown or other
  misc_feature (327)..(327): n is a, c, g, or t
  modified_base (370)..(370): a, c, t, g, unknown or other
  misc_feature (370)..(370): n is a, c, g, or t
  modified_base (558)..(558): a, c, t, g, unknown or other
  misc_feature (558)..(558): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccagaacatactgtcnctgacaactcaatacctgagaggcgagacacggctatttattctgtgcgaaggnggcagtagtagggaacgtacgtattttcgactccccgtacgcngtcgactactttgattacggcggggacccgggaaccgtggtcgccgtctcctcacgcctaccaccgacggcccagtccgtcccttccccgtcggccacccctcctaccaacgcgccaccgtcggtcggggccacgcggcccggccgttgggcttcgctggttacgacggactaactccgaagtacgtnttcaacgttgaacgg

SEQ ID NO: 358450 - DNA, 694 bp, Homo sapiens
  misc_feature: GZ8MTXP01EI7I8.9.34.D01.1.454.CMB.2.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtccgtgggccccagggcagacggtcaccatctcgtgcacgtggaagtcgctccaacagtcggggcacgttatgatgtacactacgtaaccaaacaactccaaggaacacgaccccaaagtcactactatttatacgaacaaacatacgaacgccggccctcgtaccggggttccccacggaacccgttactttcccgtcccgggtaccttaccggtaaacgttccgtacgggacccaactaacttccgaaccggtcccccttaccccggttacgggacccctaattcccgaaccggttcggggccttacccgaagggtcccgttaggaacgggtagtggaacgggtccctagttaaccttactttaaccgtcggaccctaggttacccgggttaattacggaaccgttaggtttcggaaaccctttaaaggttaaccttacgttccgttaacgttacggaacgttcggggaacccacgggttcccaaccgggtttccgg

SEQ ID NO: 358451 - DNA, 610 bp, Homo sapiens
  misc_feature: GZ8MTXP01EVKUG.9.34.D01.1.454.CMB.2.raw
  modified_base (191)..(191): a, c, t, g, unknown or other
  misc_feature (191)..(191): n is a, c, g, or t
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
  modified_base (414)..(414): a, c, t, g, unknown or other
  misc_feature (414)..(414): n is a, c, g, or t
  modified_base (469)..(469): a, c, t, g, unknown or other
  misc_feature (469)..(469): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctnagtcgtcgtcgggccccagggcagacggtcaccatcgtcgtgcacgtaggaagtagctacaacgagtcgggactacgttatgatgtactacgtacgtaacccaactaacctaccaacggaacctacgaccccctaaagtcatactatttancgaacaacntacgacgcgacccgtgaccgggtcccagccgtactccgtccgctaccgtagtcgtacgacacntaccgcgccctccgtacggcctatcgacgtcggactccgagtcgtagaggtacgnggacgtctacgttacgttacgttcgtcgtacgtaggtcgtaagtacgttacgtacggttacgtaacctaacgttaccgttcgttaccgttaacggtaaccggtaacggtaccggaaccgttacggtcccgttaaccggtcg

SEQ ID NO: 358452 - DNA, 646 bp, Homo sapiens
  misc_feature: GZ8MTXP01E426G.9.34.D01.1.454.CMB.2.raw
  modified_base (318)..(318): a, c, t, g, unknown or other
  misc_feature (318)..(318): n is a, c, g, or t
  modified_base (327)..(327): a, c, t, g, unknown or other
  misc_feature (327)..(327): n is a, c, g, or t
  modified_base (389)..(389): a, c, t, g, unknown or other
  misc_feature (389)..(389): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaaactccgtgaggggccgcttcatcatctccagagacaattcccagaacatactgtctctgcaactcaaataacctgagaggcgagacacggcatttattcngtgcgaagngcatagtggaacgtacgtattttcgactccctacgcaacgtcgactactttgagtttacggngggggacccggggtaaccctgggtaccgtccgtctccctcacgccctaccgaaccgaacgggcccctaagtccggtcccttacccccgtggccctaccccttcccaccgaaacgcgcctaccgtcgtcgggggaccaccgaacggcccgggtcccgttggggtcccttcggccccgttggggttaacccgaaagggttacccttaacccgttaccccgaaggtacccggttacttacccgaaccgttggaaccgggg

SEQ ID NO: 358453 - DNA, 590 bp, Homo sapiens
  misc_feature: GZ8MTXP01D9JG0.9.34.D01.1.454.CMB.2.raw
  modified_base (234)..(234): a, c, t, g, unknown or other
  misc_feature (234)..(234): n is a, c, g, or t
  modified_base (335)..(335): a, c, t, g, unknown or other
  misc_feature (335)..(335): n is a, c, g, or t
  modified_base (374)..(374): a, c, t, g, unknown or other
  misc_feature (374)..(374): n is a, c, g, or t
  modified_base (533)..(533): a, c, t, g, unknown or other
  misc_feature (533)..(533): n is a, c, g, or t
  modified_base (578)..(578): a, c, t, g, unknown or other
  misc_feature (578)..(578): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtggaggggccncttcatcatctccagagacaacttcccagaacatactgtctctgacaactacaataacctgagaggcgaggacacggcctatttatttctgtgacgaaggngcagtagtagggaactacgtattttcgactccctaccgncgtcactactttgacgttacggtcgggggacccgggtacccgtggtccgccgtctcctcacgtccctaccgaccgacggcccacgtccgtcccttccccggtcggccctacccctcctaccaagccgaccaccgtcggtcggggcacgcggccgtccgngggccttcggccgtggacgacggttactcctacgaagtacgtacncaacgttggcgg

SEQ ID NO: 358454 - DNA, 688 bp, Homo sapiens
  misc_feature: GZ8MTXP01C6YQC.9.34.D01.1.454.CMB.2.raw
  modified_base (238)..(238): a, c, t, g, unknown or other
  misc_feature (238)..(238): n is a, c, g, or t
  modified_base (279)..(279): a, c, t, g, unknown or other
  misc_feature (279)..(279): n is a, c, g, or t
tcagtgatacgtctcacgaccggtgctcgatttagatcgtctgtgttgggtttgggggaggcttggtccagcctgggggagtccctgcgactctcctgtgtggcctctggattcacctttgagacctatgccttgacctgggtccgccaggctccgaggggagggactgggagtgggtcgcaggcatcgctggtggcggtcatgacacattctacgacaaactccgtggacggggccncttcatcatctccagagacaacttcccagaacatactgtcnctgcaactcaaataacctgagaggcgaggacacggcctatttattctgtgacgaaggaggacagtagtagggaacttacgtattttcgactccctacgactgtccgtactacgtttcggacggttacccgggggacccgggtacccgtcgggtccgccggttcctccgtccgaccgaccctacccgaaccgaaccggggcccctacgttcccgggttccccttccccccgtacgggaccccctaacccccttccctaacccgaacgtaccgacccgtaacccgttcggacggggggtacccaaccggacggtccccggtcccgggtcgggcgttccgccgttacgggtaaccgaacggttaccgttacctttaaccgaacgtaacgtaactcacgtcggaacggccggg

SEQ ID NO: 358455 - DNA, 710 bp, Homo sapiens
  misc_feature: GZ8MTXP01BA10F.9.34.D01.1.454.CMB.2.raw
  modified_base (233)..(233): a, c, t, g, unknown or other
  misc_feature (233)..(233): n is a, c, g, or t
  modified_base (272)..(272): a, c, t, g, unknown or other
  misc_feature (272)..(272): n is a, c, g, or t
  modified_base (294)..(294): a, c, t, g, unknown or other
  misc_feature (294)..(294): n is a, c, g, or t
  modified_base (379)..(379): a, c, t, g, unknown or other
  misc_feature (379)..(379): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctcagagacaattcccagaacatactgtcnctgacaactcaataacctgagnggacgagacacggctatttatttctgtgacgaagggagcaagtagtagggtaacgttacgtatttttcgacttcccctaccgcgngttaccgaactactttagacgtttacggtacggggggtaccccggggtaacccgttgggtcccggtcccgttccgtacccttcgaaccgccccgttacccgaacccgaaacggggcccctaacggttcccgggttcccctttccccccgggtacggtcccctaccccctttaccccgacccgaaacggaccgtacccctaccgttccggggtgggggaccccacggaccgggcccgggtcccgttggggcccttgtcccggtaggttaccgaacgggttaccttaaccgttaccaacggttaccgtacttaccgtcgttcgggaaccgggg

SEQ ID NO: 358456 - DNA, 654 bp, Homo sapiens
  misc_feature: GZ8MTXP01CHX25.9.34.D01.1.454.CMB.2.raw
  modified_base (238)..(238): a, c, t, g, unknown or other
  misc_feature (238)..(238): n is a, c, g, or t
  modified_base (255)..(255): a, c, t, g, unknown or other
  misc_feature (255)..(255): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactgggagtgggtcgcaggcatcgctgggtggcggtcatgacacattctacgcaaactccggtggacggggccncttcatcatctccaganacaattcccagaacatactgtctctgactaaactacaaataacctggagaggcgaggacacggctatttattctgtgacgaaggagcaatagtagggtaacgttacgtattttcgacttcccgtacccgatcggtacgtaacttacgtttgaacgttacgggtcggggggtaccccgggtaacccgtcgggtcccgtcccgttcctcccgtcgacgtccctacccgaaccgaaccgggcccctacgttcccgttcccctttcccccggcggacccctaccccctcctaccgaacgacgccacccgtcgtcggggaccacgcggcccggtccgttgggcttcggccgtggacgaacggttaccttaacgtaccgaagtaccgtattccgaacgttgcggg

SEQ ID NO: 358457 - DNA, 549 bp, Homo sapiens
  misc_feature: GZ8MTXP01BJ192.9.34.D01.1.454.CMB.2.raw
  modified_base (85)..(85): a, c, t, g, unknown or other
  misc_feature (85)..(85): n is a, c, g, or t
  modified_base (367)..(367): a, c, t, g, unknown or other
  misc_feature (367)..(367): n is a, c, g, or t
  modified_base (539)..(549): a, c, t, g, unknown or other
  misc_feature (539)..(549): n is a, c, g, or t
tcagtgatacgtctcacgaccggtgctcgatttagatcgtctgtgttgggtttgggattcacctttgagacctatgccttgaccngggtccgccaggctccaggggagggactggagtgggtcgcaggcatcgctggtggcggtcatgacacattctacacaaactccgtgaggggccgcttcatcatctccagagacaattcccagaacatactgtctctgcaactcaatacctgagaggcgaggacacggcctatttattctgtgcgaaaggaggcatagtagggaagtacgtattttcgactcccctccgctagtcgactactttgattacgtcgggggccggaacctggtccgccccgtctcncacgccctaccaccgaacggcccagtccggtccctcccccgtggcccacccctcctaccaagcgccacctcggtcggggccacgacgccggccgtggctcgccgtggtcgaacggtacttactccgagtacgtactcacgtgacggcgggcgtggcgaacggcgacagaggnnnnnnnnnnn

SEQ ID NO: 358458 - DNA, 576 bp, Homo sapiens
  misc_feature: GZ8MTXP01A1DVO.9.34.D01.1.454.CMB.2.raw
  modified_base (233)..(233): a, c, t, g, unknown or other
  misc_feature (233)..(233): n is a, c, g, or t
  modified_base (273)..(273): a, c, t, g, unknown or other
  misc_feature (273)..(273): n is a, c, g, or t
  modified_base (368)..(368): a, c, t, g, unknown or other
  misc_feature (368)..(368): n is a, c, g, or t
  modified_base (508)..(508): a, c, t, g, unknown or other
  misc_feature (508)..(508): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactgggagtgggtcgcaggcatcgctggtggcggtcatgacacattctacgcaaactccgtgaggggccncttcatcatctccagagacaattcccagaacatactgtcnctgcaactcaataacctgagaggcgaggacacggctatttattctgtgcgaaggagcatagtagggtaacgtacgtattttcgactccctccgcngtcgactactttgagttacgtggggacccggggtacctggtccgccgtctcctcgacgccctccaccgaacgggcccacgtcgtccttcccgtcgtcggcccacccctcctaccacgacgccaccgtcgtcggggcacgngccggccgtggccgtcgccgttaggccaacggaaccttacgtcccgagtacgttactcgcgtaacggg

SEQ ID NO: 358459 - DNA, 720 bp, Homo sapiens
  misc_feature: GZ8MTXP01D4FFF.9.34.D01.1.454.CMB.2.raw
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
  modified_base (590)..(590): a, c, t, g, unknown or other
  misc_feature (590)..(590): n is a, c, g, or t
  modified_base (633)..(633): a, c, t, g, unknown or other
  misc_feature (633)..(633): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtgggcggtcatgacacattctacgacaaactccggtagacggggccncttcatcatctccaaganaacaacttcccaagaaacatactgtctactcgacaaactactaaactaaacctggaacggaggacgaacgggaaccacgggtacccttaatttttaagtttcgtaggttcggaacggaaagggaggactaagtaagtaggggaaacttacgtattttcggaacttccccgtaccgactaacggtccgaacttacgttttacgaacgtttaccgggcggggggtaccccgggaacccgttcggtccgtccgtcctccgtcacgccctaccaaccgaaccggccctaacgtccgtccccttccccggtacggccctaccccgtacctaccgaaacncgacctaccgttcggtcggggaccacgacccggcggtccccgngggtaccgttcgtccgtacgggttacgttaaacggttaccttaacctaccgaagttaacggtacttacgtaaccgaagggtccgggg

SEQ ID NO: 358460 - DNA, 802 bp, Homo sapiens
  misc_feature: GZ8MTXP01ESZPR.9.34.D01.1.454.CMB.2.raw
  modified_base (237)..(237): a, c, t, g, unknown or other
  misc_feature (237)..(237): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgcgtgggtggcggtcatgacacattctacgcaaactccgtggacggggccncttcatcatctcagagacaattcccagaacatactgtctctgacaactacaataactgagaggcgaggacacggtctatttattctgtgacggaaggagacagtagtagggtaacgtacgtattttcgacctccccgtaccgacgtaacggttaccgtaaaccttacgttttggtaaacgtttacggggtacggggggtaccccgggggtaacccgttcggggtacccggtcccggttccgttaccccgtccgtaaccgtccccgttaacccgaacccggaaccggggtacccctaacgttccccggggttccccttcccccggggtcgggtacccttacccgttacccctaccccgttacccgaaacgtaccgtacccgtaacccggttcccgggtacggggggtaccccaaaccgggaaccgggtccccggggttcccccgggtcgggggttccccgttacgggtccccggtttacgggttaacccgttaaacggggttaacctttaccccgttcccggtaaacggtaccccggtttaatcccgttaaacgggttaaccgggg

SEQ ID NO: 358461 - DNA, 694 bp, Homo sapiens
  misc_feature: GZ8MTXP01CATKB.9.34.D01.1.454.CMB.2.raw
  modified_base (190)..(190): a, c, t, g, unknown or other
  misc_feature (190)..(190): n is a, c, g, or t
  modified_base (252)..(252): a, c, t, g, unknown or other
  misc_feature (252)..(252): n is a, c, g, or t
  modified_base (345)..(345): a, c, t, g, unknown or other
  misc_feature (345)..(345): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcacgccgcctnagtgtcgtcgggcccagggcagacggtcaccatctcgtgcacgtggaagtagctaccaacgngtcgggcaacgttatacgatacgtacacgtacggtaaccaaacaacttaccgaagaaccaacgtacccccaaagtctaacttctaattttaanacgaacaaactaagtacggaaacggccggaccctacggaccggggtaacccctcggaacccgtacttcccggtacccgacctaccgaagtccgtggaccctaacacctacaccggtccccttaccgtcgtaccaacgttccgaacgttcgggaccctaccggtacggccggtaggtaacggaacgttcgggacgtccgtaagttaaccgtttacgttaccgttccgacccttagggtcttaacgtgaccgttaggttaccggtaaacgttaacgttaacgttcgtttacgttaacgttaaccgggaacgttaccgggaccgttacgggtttcccgaaccgtttcccggg

SEQ ID NO: 358462 - DNA, 608 bp, Homo sapiens
  misc_feature: GZ8MTXP01BALAY.9.34.D01.1.454.CMB.2.raw
  modified_base (233)..(233): a, c, t, g, unknown or other
  misc_feature (233)..(233): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccagaacatactgtctctgacaactacaaataacctagagaggcgagacacggacctatttattctgtgacggaaggaggcagtagtagggtaacgtacgtattttcgacttcccctaccgactaacgtccgtactacgtttgtaacgtttacggtcgggggacccggggtaaccctgggtccgccgtctcctcgacgccctaccacgacggccactccggtccctcccgtcgccaccctcctacgaagcgacgaccgtcggtcggggcacgcggccgccgttggggcttcggccgtggaccgacggttctaaccgttccgaacgtacgtacttcgaacgttcggaacggg

SEQ ID NO: 358463 - DNA, 721 bp, Homo sapiens
  misc_feature: GZ8MTXP01DEM1I.9.34.D01.1.454.CMB.2.raw
  modified_base (235)..(235): a, c, t, g, unknown or other
  misc_feature (235)..(235): n is a, c, g, or t
  modified_base (251)..(251): a, c, t, g, unknown or other
  misc_feature (251)..(251): n is a, c, g, or t
  modified_base (272)..(272): a, c, t, g, unknown or other
  misc_feature (272)..(272): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggaggtgggtcgcaggcatcgctggtggcggtcatgacacattctacgacaaactccgtgaggggccncttcatcatctcaganacacttccagacatactgtcnctgcaactacaataacctgagagacgagacacggctatttattctgtgacggaaggaggactagtagtagggtaacgtacgtattttcgacctcccctaccgctaacgtcgaaccttactttagtaacgtttacgggtacggggggaccccgggggtaacccgtcgggtcccggtcccggttcctcccgttacccgaacggtccccttacccgaacccggtaaaccggggtccccaacgttcccggggttcccccttcccccgggttccgggtcccctaacccccttccccgtaacccaaacggtacccgaccgtaacccggttccggtcgggggacccaacggccggggcccggtcccggttcgggtcccgttcgtcccgtcgggttaaccgaacgggttacccttaacgtaaccgtaacgtacgtacttaccgtgaacggtccgggg

SEQ ID NO: 358464 - DNA, 561 bp, Homo sapiens
  misc_feature: GZ8MTXP01EE4H4.9.34.D01.1.454.CMB.2.raw
  modified_base (231)..(231): a, c, t, g, unknown or other
  misc_feature (231)..(231): n is a, c, g, or t
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
  modified_base (488)..(488): a, c, t, g, unknown or other
  misc_feature (488)..(488): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccncttcatcatctccagagacaattcccagaacatactgtctctgcaactcaataacctgagaggcgaggacacggcctatttattctgtgacgaaggngacatagnggggaaatacgattttcgatcccctacgctaagtcgaactacgtttgacgtttacgtgggggacccgggaaccctggtccgccgtctcctcacgcctccaccaacgggcccatccggtccttccccggtgccctaccctccgaccaagaccnccaccgtcggtcgggacacgcgccgccgttggcttcgcgtcgacgacgttactaactcaacgctanctgngng

SEQ ID NO: 358465 - DNA, 658 bp, Homo sapiens
  misc_feature: GZ8MTXP01EMKY1.9.34.D01.1.454.CMB.2.raw
  modified_base (231)..(231): a, c, t, g, unknown or other
  misc_feature (231)..(231): n is a, c, g, or t
  modified_base (568)..(568): a, c, t, g, unknown or other
  misc_feature (568)..(568): n is a, c, g, or t
  modified_base (579)..(579): a, c, t, g, unknown or other
  misc_feature (579)..(579): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccnttcatcatctcagagacaattcccagaacatactgtctctgacaactcaaataacctggaagaggcgaggacacggtcctatttatttctgtgacggaaagggaggacatagtaggggtaaacgtacggtaatttttcggactccccgtacgactaagttccgactacgttttgactttacgggcgggggacccggggtaacccgtgggtccgtccggtcctccctcgacgcccttaccgaacccgtaacgggcccctaacgtcccggttcccttccccccgggtggtcccctaacccctccctacccgaagacgccaccgtcgtcgggggccacgnggccggtcccnggggtccttcggtccgttcgggaccgaacgggttacttaacccgttccgaacgtcggtaattccaacgttcggaacggg

SEQ ID NO: 358466 - DNA, 808 bp, Homo sapiens
  misc_feature: GZ8MTXP01CFCTM.9.34.D01.1.454.CMB.2.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagttctgttctgacgcacgccgccctcagtcgtcgtcggggccccagggcaggacggtccaccatcgtcgtgctacgtagggaagtacgcctaccaaacgagtccgggggctaacggttatacggattacggtaacctaaccgttacggtaaaccccaaaacctaaaccgtttacccgaaacgggaaacccaacccggaacccccctaaaaggttccaaactttactaaactttttaacgacgaaacctaaactaacgttacggaaaccggccggtaccccgtacggtacccgggggttacccctacggtaacccgtactttcccgtcccggctaccgaacggttctcggacctacgtactccgaccgtccccgttcccgtacggaccctacgtcccgaaccggttcgggcccttaccggaacgggtcgtacggggtaaaggcgttacgggaacgggttcctaacggtaacctttaacgttaccgtcggtaccctagggttccgtaagttacggacgtaaacgggttaccggtaaacccttaaaggttaaccgttacgtttcccggttaacggtttaacccgggaaacggttccggggtaaacccgttaacggggttccccgttaaacccgggtttcccggg

SEQ ID NO: 358467 - DNA, 597 bp, Homo sapiens
  misc_feature: GZ8MTXP01EP4S2.9.34.D01.1.454.CMB.2.raw
  modified_base (306)..(306): a, c, t, g, unknown or other
  misc_feature (306)..(306): n is a, c, g, or t
  modified_base (323)..(323): a, c, t, g, unknown or other
  misc_feature (323)..(323): n is a, c, g, or t
  modified_base (348)..(348): a, c, t, g, unknown or other
  misc_feature (348)..(348): n is a, c, g, or t
  modified_base (505)..(505): a, c, t, g, unknown or other
  misc_feature (505)..(505): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctggggggaggcttggtccagcctggggagtccctgcgactctcctgtgtggcctctggattcacctttgagacctatgccttgacctgggtccgccaggctccgagggggagggactgggagtgggtcgcaggcatcgctgggtggcggtcatgacacattcacgcaaactccgtgacggggccncttcatcatctccaganacaattcccagaacatactgtctcngcaactcaaatactgagaagcgaagacacggctagtttattcgtgtgacgaaggagacagtagtgggtaaatacgtatttcgacttccctcgcacgtcgtactcgtttacggtacgtcgggggcccggaccgttggtccgtccgtcctcctcgaccnccctccaccgaacggccctacgttcccggttcccttcccccgttggcccctaccccgtccctaccacggttactcccgttaaccgtccgggg

SEQ ID NO: 358468 - DNA, 506 bp, Homo sapiens
  misc_feature: GZ8MTXP01EAT6H.9.34.D01.1.454.CMB.2.raw
  modified_base (285)..(285): a, c, t, g, unknown or other
  misc_feature (285)..(285): n is a, c, g, or t
  modified_base (289)..(290): a, c, t, g, unknown or other
  misc_feature (289)..(290): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (302)..(303): a, c, t, g, unknown or other
  misc_feature (302)..(303): n is a, c, g, or t
  modified_base (328)..(328): a, c, t, g, unknown or other
  misc_feature (328)..(328): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (418)..(418): a, c, t, g, unknown or other
  misc_feature (418)..(418): n is a, c, g, or t
  modified_base (485)..(485): a, c, t, g, unknown or other
  misc_feature (485)..(485): n is a, c, g, or t
  modified_base (490)..(506): a, c, t, g, unknown or other
  misc_feature (490)..(506): n is a, c, g, or t
tcagtgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcgacggggtccctgaccgattcctccggctccaagtctggcacatcagccctccctggccatcacgtggctcgagcngagnngngntnatatcnnctgtcatgataggtgactaagtacntcgtcgttaccgacgtcgggacagtccaaccgtcgtgggcaccgacccgaacgaccccaacccngttcnccctacttccgtcctaccccncccttctacgacgtacgtacctcgacgtgggaccgggtcgggtacgcggggaacgaaccggtcgaanagcgnnnnnnnnnnnnnnnnn

SEQ ID NO: 358469 - DNA, 664 bp, Homo sapiens
  misc_feature: GZ8MTXP01DB3Z9.9.34.D01.1.454.CMB.2.raw
  modified_base (304)..(304): a, c, t, g, unknown or other
  misc_feature (304)..(304): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagccctggggagtccctgcgactctcctgtgtggcctctggattcaccttttgagacctatgcccttgacctggtccgccaggctccgaggggaggactgggagtgggtcgcaggcatcgctgggtggcggtcatgacacatctacgcaaactccgtgaggggccncttcatcatctccagagacaattcccagaacatactagttctctcgtacaacctaactacgtaaactacgaggaacgacggaacgacgaccgacgtactttatttactgtacgtagagtaggagatagtaggtaacggattacgtagttccaccttccgacgtacgtacgggtacttaacgttacgtttacgtaccggtaccgggggtacccgggggtacccggtaccggttcggtcccggttcccgttcccaacccgccgtacccgttacccgacccgttaacccgaccggtaacccgttccgttcccgttcccgtccccgtcccgccctccctacccttaccgtaacgaaccgtcccg

SEQ ID NO: 358470 - DNA, 717 bp, Homo sapiens
  misc_feature: GZ8MTXP01B6LC7.9.34.D01.1.454.CMB.2.raw
  modified_base (176)..(176): a, c, t, g, unknown or other
  misc_feature (176)..(176): n is a, c, g, or t
  modified_base (193)..(193): a, c, t, g, unknown or other
  misc_feature (193)..(193): n is a, c, g, or t
  modified_base (228)..(228): a, c, t, g, unknown or other
  misc_feature (228)..(228): n is a, c, g, or t
  modified_base (340)..(340): a, c, t, g, unknown or other
  misc_feature (340)..(340): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacgagggtcctgggcccagtctgttcngacgcacgcccgccctnagtgtcgtcggggcccagggctaggacggtcaccntcgtcgtgcacgtgggaaacgtacgctaccaacgagtcggggactacgttatgatgtacacgtggtaaccaacaactccaaggaacacgtaccccaaagtcatactatttanagaactaacatacgaacgcggcccgtacgacggggtaccctacgaaccgtacttccgtcccggtacctaccgtaaacggttctacggacctaacactaccgacggtccccctcccggtacggaccctaacgttcccgaacggttcggggaccttacccgggaagggtcccggttaggggtaacgggtacgtagggtaaccgggcttaacggtaaccgtttaaactttaaccgtccgggaacctacgggttaccgtaaagttcggaaccgtaaggttaccggtaaacccttaaagttaaccgttcgtttaccgttcggttaaccggtaaccgttaccggggaaccttaaacgggtcccgttaacccggtttcccgggg

SEQ ID NO: 358471 - DNA, 576 bp, Homo sapiens
  misc_feature: GZ8MTXP01EDQ39.9.34.D01.1.454.CMB.2.raw
  modified_base (328)..(328): a, c, t, g, unknown or other
  misc_feature (328)..(328): n is a, c, g, or t
  modified_base (515)..(515): a, c, t, g, unknown or other
  misc_feature (515)..(515): n is a, c, g, or t
  modified_base (534)..(534): a, c, t, g, unknown or other
  misc_feature (534)..(534): n is a, c, g, or t
  modified_base (552)..(552): a, c, t, g, unknown or other
  misc_feature (552)..(552): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtcgtggggccccagggcagaggtcaccatctcgtgcacgtggaagtagctaccaacagtcggggcacgttatgatgtacacgtcggtaaccaaacactccaaggaaccacgaccccaaagtcatactatttanagaacaacatacgaacgccggcctcgacggggtcccctagaacccgtattcccgtcccggactaccgaaggttcgtacggaccaactaactccgacgcccttcccgtacggacctatccgacgtcgggcctcgaggcgtaggacggtatggagtcgtagtactacgttctgacctagtcgaatcganggttacgacctaagttacngttcgtcgttacggaacncgggaccacggtccgaacgttccg

SEQ ID NO: 358472 - DNA, 641 bp, Homo sapiens
  misc_feature: GZ8MTXP01CEC4E.9.34.D01.1.454.CMB.2.raw
  modified_base (233)..(233): a, c, t, g, unknown or other
  misc_feature (233)..(233): n is a, c, g, or t
  modified_base (250)..(250): a, c, t, g, unknown or other
  misc_feature (250)..(250): n is a, c, g, or t
  modified_base (303)..(303): a, c, t, g, unknown or other
  misc_feature (303)..(303): n is a, c, g, or t
  modified_base (627)..(627): a, c, t, g, unknown or other
  misc_feature (627)..(627): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactgggagtgggtcgcaggcatcgctggtggcggtcatgacacattctacgcaaactccgtgagggccncttcatcatctccaganacaacttcccagaacatactgtctctgcaactcaatacctgagagcgaggacncggctattttattctgtgacgaaggagacatagtagggaactacgtatttccgactcccctccgactgtcgaactacgttttagacgtttacggtcgggggacccgggtacccgttcggccgtccgtcctcctcacgccctaccaccgacggccctacgtccgtccccttccccgtacggtccctaacccctcctacccgaagccgccctacccggtcggtcgggggaccaaccgcgggtccccggcccggttgggcccgttcggtccccgttgggaccgaaacgggttccttaaccgttcccaacggttacctacggttaccncggttaaggccggg

SEQ ID NO: 358473 - DNA, 638 bp, Homo sapiens
  misc_feature: GZ8MTXP01AL8I8.9.34.D01.1.454.CMB.2.raw
  modified_base (339)..(339): a, c, t, g, unknown or other
  misc_feature (339)..(339): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagcccgccctcagtgtcgtcggggccccagggcaggaggtccaccatctcgtgcactagggaagtacgcctaccaacgacgtcggggctacgttatgatcgtacacgtacggtaaccaaacactccgaagaacacgaccccaaagtcatactatttanagaacaacatacgaacgcggaccctcgacggggtccctagccgtacttccgtcccggcctaccgtaacgtcgtacgaccaactacgtccaccgtcccctcccgtacggacctactccgacgtcgggacctccgaggcgtaggaggtctaggacgtctagtaacttacttacgtcgaccgtaggtcgtaatacggacgtacggttacggtaaccttaaaggttaccttcgttaccggttaaccgttaacgggaaccgttacggggaaccgttaacgggttcccgaacccggtttcccggg

SEQ ID NO: 358474 - DNA, 624 bp, Homo sapiens
  misc_feature: GZ8MTXP01DIL5P.9.34.D01.1.454.CMB.2.raw
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
  modified_base (296)..(296): a, c, t, g, unknown or other
  misc_feature (296)..(296): n is a, c, g, or t
  modified_base (335)..(335): a, c, t, g, unknown or other
  misc_feature (335)..(335): n is a, c, g, or t
  modified_base (374)..(374): a, c, t, g, unknown or other
  misc_feature (374)..(374): n is a, c, g, or t
tcagtgatacgtctcacgaccggtgctcgatttagatcgtctgtgttgggggtttgggggaggcttggtccagcctgggggagtccctgcgactctcctgtgtggcctctggattcacctttgagacctatgccttgacctgggtccgccaggctccgaggggagggactgggagtgggtcgcaggcatcgctgggtggcggtcatgacacattctacgcaaactccgtgaggggccncttcatcatctcaganacaattcccaagaacatactgtctctgacaactcaaataccngagaggcgaggacacggctatttattctgtgacgaaggngacagtagtaggtaacgtacgtatttcgactccctcgancgtcgactacttgacgttacggtcgggggacccgggacctcggtccgccgtctccgtcacgtccctaccaaccgaacgggccctacgtccggtcccttccccggtcggaccctacccctcctaccgaacgacgccacccgtcgtcgggggaccaccgcgcccggcccgttcgggccttcggcccgtcggaccgttaacggttaccttaacccttaccgtaaacgtctaccgacgtcggaacggcccgggg

SEQ ID NO: 358475 - DNA, 692 bp, Homo sapiens
  misc_feature: GZ8MTXP01C5XPA.9.34.D01.1.454.CMB.2.raw
  modified_base (318)..(318): a, c, t, g, unknown or other
  misc_feature (318)..(318): n is a, c, g, or t
  modified_base (325)..(325): a, c, t, g, unknown or other
  misc_feature (325)..(325): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgccgccctcagtgtctcggggccccagggcagaggtcaccatctcgtgcacgtggaaagtagctaccaacgagtcggggcacgttatgatgtacactgtaccaacactcagacacgaccccaagtcatcatttanagaacanactacgacgcgcctcgacgggtcccagccgtacttccgccggctacccgtaagtcctacgggacctaacgtacttaccgacgtccccttcccgtacggaccctatcccgaacggtcgggacccttaccgaagggtcgttacgggaacgggtagttacgggaaccggtccgtacggttaaccttaacgtttaccgtacggtacccgtaacggtttccggtaaagttacggaaacgtacgggttacggttaaaccccgttaaaggtttaaaacccgttcgtttacccgggttaaccgtttaaccggggaaaccggtttaccgggggaaacccgttaaacggggttccccgaaaccccgggtttcccggg

SEQ ID NO: 358476 - DNA, 752 bp, Homo sapiens
  misc_feature: GZ8MTXP01ARARD.9.34.D01.1.454.CMB.2.raw
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (270)..(270): a, c, t, g, unknown or other
  misc_feature (270)..(270): n is a, c, g, or t
  modified_base (326)..(326): a, c, t, g, unknown or other
  misc_feature (326)..(326): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctcaganacaatcccagaacatactgtcnctgcaactcaatacctgagaggcgaggacacggtctatttattctgtgacgaaggngcagtagtggaacgtacgtattttcgactccctaccgctaacgtacgactacgttttaggacgtttaccgggtacggggggtaccccggggtaacccgttcggggtcccggtccccgttcgttccccgttacgaccggtccccttaccccgaaaccccggaaacccggggtcccctaacggttccccgggttacccctttacccccccggggtcgggtacccctaccccccttaccccgttacccgaaacggaccgtcccgtaaccccgttccgggtaccggggggaccaccggaccgggtccccgggtccccgttgggggtcccttccgggtcccgttacggggttacccgaaacggggttaccccttaacccgttacccgtaacggtacccgttacgttacccgtaacggttcgggtaaccggg

SEQ ID NO: 358477 - DNA, 734 bp, Homo sapiens
  misc_feature: GZ8MTXP01DXR5X.9.34.D01.1.454.CMB.2.raw
  modified_base (193)..(193): a, c, t, g, unknown or other
  misc_feature (193)..(193): n is a, c, g, or t
  modified_base (344)..(344): a, c, t, g, unknown or other
  misc_feature (344)..(344): n is a, c, g, or t
  modified_base (381)..(381): a, c, t, g, unknown or other
  misc_feature (381)..(381): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtcttgttctgacgcacgccgccctnagtcgtcgtcgggccccagggcagacggtcaccatcgtcgtgcacgtggaaagtcgcctaccaacgagtcggggactacgttatgaatcgtaccacgtgtaacccaaactaaccttcgaaggaaccacgaccccaaagtcattctatttanacaacaacatcgacgccgcccgtacgacgggtacccngccgtattccgcccggtacnccagttcgngaccacactccacgtccctcccgtacggaccctacgttcccgacgtcgggtacctaccggtacggtaccgttaggggaacggtaaagttcgggaacggtcttaacggttaacttaaacccgtttcgccggtaaccctaggtttccggtaaacgttacggaaaccggtaggtttaaccgggtaaacccgtttaaaacggttaaacctttccggtttaacccgggtttccgggttttaaaaccccgggaaaccggggtttaacccgggggaaaccccggttaaaacggggtttcccccgaaaccccggggtttttaaccccggggg

SEQ ID NO: 358478 - DNA, 856 bp, Homo sapiens
  misc_feature: GZ8MTXP01BB1SE.9.34.D01.1.454.CMB.2.raw
  modified_base (262)..(262): a, c, t, g, unknown or other
  misc_feature (262)..(262): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggagggactgggaggtgggtcgcgaggcatcgcgtgggtgggcggtcatgacactattctacgacaaactccggtggacggggcctcttcatcatctccaganactaacttcccaagaacatactgtctcagacaactacaaactaacctgagaggacgacggaccacggtacctattttatttcgtggtacggacggaagggaggactaagttaggtaggggtaaacgttacggttattttaccgaccttccccgtaccgactaacggtaccgtaacttacgttttacggaacgtttaccggggtcgggggggtaccccgggggtaaccccgttcggggtacccggtcccggttcccgttccccgtaccgtaacccggtaccccgttaccccgaaaccccgggaacccggggtaccccgttaaccggtttccccgggtttacccccgtttcccccccggggttaccggggtacccccttaacccccgttaccccgttaaacccggaaaccggtacccggtacccgttaaccccggttccggggtaccggggggaccctaacccgggacccgggtcccggggtccccggttcgggggtccgttaccgggtcccggttacgggttaaccggttaacgggttacccttaaccgttacccgaacggttaccgtacgttaccgtaacgttcgggtaacggg

SEQ ID NO: 358479 - DNA, 780 bp, Homo sapiens
  misc_feature: GZ8MTXP01EDCH8.9.34.D01.1.454.CMB.2.raw
  modified_base (305)..(305): a, c, t, g, unknown or other
  misc_feature (305)..(305): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtcgtgggggaggcttggtccagcctggggagtccctgcgactctcctgtgtggcctctggattcacctttgagacctatgccttgacctgggtcccgcaggctccgaggggaggactggagtgggtcgcaggcatcgcgtgggtggcggtcatgacactattctacgcaaactccgtgacgggccncttcatcatctaccagagactaactcccagaaccatactgttactctagaccaaacctcaaaattaacccgaggaacggaacgggacgaaggaaccgaccgggtaccctttaattttaactttcgtagggtacgaccgggaaagggacggtacgtaaagttaaggtaaggggtaaaacgttaccggtttaacgttttacccggaaaccttcccccgtaccgacgtaacggttacccggtaaacgttacgttttacggaaacgtttccggggtaccggggggaccccggggttaacccgttcggggtcccgtccccggttacccttccccgtaccgaacccggtccccttaccccggaaacccgaaccggggtcccctaacgttccccgggtttcccccgtttacccccccgtcgggtccccctaacccccgtttccccgtaaccgaaaccgccggttaaccccgttaaccccggg

SEQ ID NO: 358480 - DNA, 720 bp, Homo sapiens
  misc_feature: GZ8MTXP01CGNU1.9.34.D01.1.454.CMB.2.raw
  modified_base (280)..(280): a, c, t, g, unknown or other
  misc_feature (280)..(280): n is a, c, g, or t
  modified_base (345)..(345): a, c, t, g, unknown or other
  misc_feature (345)..(345): n is a, c, g, or t
tcagtgatacgtctcacgaccggtgctcgatttagatcgtctgtgttgggtttgggggctctgcttcagctttgggcacaagaggcagcactcaggacaatctccagcatggcctggtctcctctcctcctcactctcctcgctcactgcacgagggtcctgggcccagtctgttctgacgcacgcccgccctcagtcgtcgtcggggccccagggcaggagggtcaccatctcgtgacacgtgggaacgtacgctaccaacgagtcggggacacgttangatgtacacgtacggtaaccaactaaccttccgaacggaacacgaccccaaagtcatctaattanacgacaacatacggaaccgccggacctcggacggggtccctaacgacccgtaactccgtcccggactaccgtaacgtcgtacggacctactactcccgacgtccccgttcccgtcggacctactacgaccggtcggtacctccgagggccgttacgggggaaggtacgtcggtaacggtcttaacggtaacctttacgttaaccgtcggtacccgttaaggttaccggttaagtaaccggaaacggttacgggtaaccggttaaccgttaaaacgttaaccgttacggtttcccgggtttaccgttaaccggggaacccgttcggggaaaccccgttaacgggttcccgttaacccgggttcggttaacccgggg

SEQ ID NO: 358481 - DNA, 607 bp, Homo sapiens
  misc_feature: GZ8MTXP01CL11K.9.34.D01.1.454.CMB.2.raw
  modified_base (233)..(233): a, c, t, g, unknown or other
  misc_feature (233)..(233): n is a, c, g, or t
  modified_base (274)..(274): a, c, t, g, unknown or other
  misc_feature (274)..(274): n is a, c, g, or t
  modified_base (336)..(336): a, c, t, g, unknown or other
  misc_feature (336)..(336): n is a, c, g, or t
  modified_base (579)..(579): a, c, t, g, unknown or other
  misc_feature (579)..(579): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactgggagtgggtcgcaggcatcgctggtggcggtcatgacacattctacgcaaactccgtgagggccncttcatcatctcagagacaacttcccaagaacatactgtcnctgacaactcaaataaccgtgagaggcgaggacacggctatttattcgtgtagacggaaggngacaagtagtagggtaaacgtacgtattttcgaactcccctacgactaagtccgactacgtttgaagttaccgggcgggggtaccccgggtaacccgtggtcccgtccgtcctacccgtcacgtccctaccgaccgacggccctaacgtccgtccctccccgtgaccctacccctcctacgacgactcaccctggcgggcacgcgtccggccttgggcttcgccgtgttaccgagccttaacnccgaagaccgtattccgaagttgaacgg

SEQ ID NO: 358482 - DNA, 727 bp, Homo sapiens
  misc_feature: GZ8MTXP01DXR34.9.34.D01.1.454.CMB.2.raw
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
  modified_base (334)..(334): a, c, t, g, unknown or other
  misc_feature (334)..(334): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtcccgccaggctccgaggggagggactgggagtgggtcgcaggcatcgctggtggcggtcatgacacattctacgcaaactccgtgaggggccncttcatcatctccaganacaacttcccaagaacatactgtctctgcaaactacaataacctgagaggcgagacacggcctatttattctgtgagaaggngctagtgtagggaatacgtatttccgactccccgtaccgactcgtacgtaaccttacgtttacggaacgtttaccggggtacggggggtaccccggggtaaccccgttggggttacccgtcccggtccttccctacgtaacccggccccttacccgaacccggaaccgggtcccctaaccggttccccggtttccccccgtttccccccggggtacgggacccccttaaccccttccccgtacccgaaacggccgtacccgtacccgttccgggtaacgggggcccacggacggcccggtcccggttgggtcccgttcgtacccgtggttaaccgacggttaccttaaccgttacccgaagttaccgtacgttcgtaacgttcgggaaccggg

SEQ ID NO: 358483 - DNA, 661 bp, Homo sapiens
  misc_feature: GZ8MTXP01C694X.9.34.D01.1.454.CMB.2.raw
  modified_base (231)..(231): a, c, t, g, unknown or other
  misc_feature (231)..(231): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcgtcatgacacattctacgcaaactccgtgagggccncttcatcatctccagagacaacttcccagaacatactgtctctgacaactacaataacctgagaggacgaggacacggcctatttattctgtgcgaaggaggcagtagtgggtaactacgtattttcgacttccctaccgctaacgtcgaaccttacttttgtaacgtttacgggtcggggggtacccggggtaacccgttcgggtccgtcccgtccttccctcgtaccgccctacccgaacccgaaccgggccccaacgttccggttccccttcccccggtcgccctacccctccctaccaacgcgaccacccgttcggtcggggccaccgcggccggtcccgttcggggccttcgtcccgtcggttaccgacggttaacccttaaccgttaccgaacgtaccgtacttacgtaacgttcggtaacggg

SEQ ID NO: 358484 - DNA, 595 bp, Homo sapiens
  misc_feature: GZ8MTXP01BWXE6.9.34.D01.1.454.CMB.2.raw
  modified_base (235)..(235): a, c, t, g, unknown or other
  misc_feature (235)..(235): n is a, c, g, or t
  modified_base (334)..(334): a, c, t, g, unknown or other
  misc_feature (334)..(334): n is a, c, g, or t
  modified_base (470)..(470): a, c, t, g, unknown or other
  misc_feature (470)..(470): n is a, c, g, or t
  modified_base (493)..(493): a, c, t, g, unknown or other
  misc_feature (493)..(493): n is a, c, g, or t
  modified_base (533)..(533): a, c, t, g, unknown or other
  misc_feature (533)..(533): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctgggtggcggtcatgacacattctacgcaaactccgtgacggggccncttcatcatctccagagacaacttcccagaacatactgtctctgcaactacaataacctgagaggcgaggacacggcctatttattctgtgacgaaggngcatagtgggaacgtacgtattttcgactcccctacgctgtcactactttgacttacggtcgggggacccgggtacccgtggtccgccgtctccgtcacgcctaccaccgacggcccagtccgtcccttccccggngccctacccgtcctaccaacgcncctaccgtcggtcgggggcacgcggccggcccgttgggcncgtaccgtggttacgacgggttacctaactccgaagtacgtattccgtaacgttcggaacgg

SEQ ID NO: 358485 - DNA, 706 bp, Homo sapiens
  misc_feature: GZ8MTXP01AG21Z.9.34.D01.1.454.CMB.2.raw
  modified_base (233)..(233): a, c, t, g, unknown or other
  misc_feature (233)..(233): n is a, c, g, or t
  modified_base (274)..(274): a, c, t, g, unknown or other
  misc_feature (274)..(274): n is a, c, g, or t
  modified_base (321)..(321): a, c, t, g, unknown or other
  misc_feature (321)..(321): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccaagaacatactgtcnctgcaactcaataacctgagaggacgaggacacggctatttattcgngtgacgtaaggaggcagtagtagggtaacgtacgtattttccgacttccccgtaccgactaacggtccgtaaaccttacgttttaggtaacgttttacgggacggggggtaccccggggtaacccgtgggtcccggtccgtccgttccctcgaccgtccctacccgaacccgaaacggggtcccctaacgtcccgggttcccttccccccgggtcgggtacccctaccccgttccctacccgaacggaccgtacccgtaacccgtcggtcgggggaccaaaccggcggtcccgggcccgttggggtcccttcggtccgtacggttacgaacgggttaccttaaccgtcccgaacgtacgtacttaccgtaacgttcgggaacggg

SEQ ID NO: 358486 - DNA, 663 bp, Homo sapiens
  misc_feature: GZ8MTXP01DFQBR.9.34.D01.1.454.CMB.2.raw
  modified_base (234)..(234): a, c, t, g, unknown or other
  misc_feature (234)..(234): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgacggggccncttcatcatctcagagacaacttcccaagaacatactgtctctgacaactcaaataacctgagaggcgagacacgctatttattctgtgacgaaggagcaagtagtagggtaaactacgtattttcgacttcccctacgctaacgtacgaacttacgtttagacgtttacgggtcgggggaccccgggtaacccgtggtcccgccgtctccctcgaccgccctaccgaaccgaaccgggccctaacgtccgttccccttcccccggtcggtacccctacccctcctaccgaacgccgaccgtaccgttcggtcgggggacccaaccgcggcccggtcccgttcggggccttcggtaccgtcgggttaaccgaacgggttaccttaaccgttaccgaacgtaccgtacttaccgaacgttaagggccggg

SEQ ID NO: 358487 - DNA, 602 bp, Homo sapiens
  misc_feature: GZ8MTXP01CG9HQ.9.34.D01.1.454.CMB.2.raw
  modified_base (319)..(319): a, c, t, g, unknown or other
  misc_feature (319)..(319): n is a, c, g, or t
  modified_base (409)..(409): a, c, t, g, unknown or other
  misc_feature (409)..(409): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgagggggaggactggagtgggtcgcaggcatcgctgggtggcggtcatgacacattctacgcaaactccgtggagggccgcttcatcatctcaganaacaatcccagaacatactgtctctgcaaacctcaaataacctgagaaggcgaaggacacggcctatttacttctgtgacgaaggagganatagtaggtaagtacgtattacgtactcctccgactacgtacgtactacgttagtagttcgtcggtcggggaccgggtaacccgtcggtccgtccgtccgtcctcacgccctacccgaaccgaaaccggaccgttacgttccgttcccgttccccgtccgccctaccctacccttaccgtaacgaacgaaccg

SEQ ID NO: 358488 - DNA, 600 bp, Homo sapiens
  misc_feature: GZ8MTXP01CHVDC.9.34.D01.1.454.CMB.2.raw
  modified_base (310)..(310): a, c, t, g, unknown or other
  misc_feature (310)..(310): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
  modified_base (397)..(397): a, c, t, g, unknown or other
  misc_feature (397)..(397): n is a, c, g, or t
  modified_base (447)..(447): a, c, t, g, unknown or other
  misc_feature (447)..(447): n is a, c, g, or t
tcagtgatacgtctcacgaccggtgctcgatttagatcgtctgtgttgggtttgggctgacctggctttttctcgtggctgttttaaaaaggtgtccagtgtgaggttcaactgttggagtctgggggaggcttggtccagcctggggagtccctgcgactctcctgtgtggcctctggattcacctttgagacctatgccttgacctgggtcccgccaggctccgagggggagggactgggagtgggtcgcgaggcatcgctgggtggcggtcatgacacattctacgcaaactccgtggacggggccncttcatcatctccagagaacaacttcccaagaaccatactgtctctgacaacctcaaatacngagaagcgngacacgctatttatcngtgacgaaggagacagtagtagggtaagtacgtatttcgacttcccgcgnacgtcggtactacgtttagacgttacggtcggggcccggtaacctcggtccgtccgtctcctcaacgtccacccgaccgaacgggtccctacgttcccgttcccttccccgtcgccctaacccctcctacgaacgaaccgttccgtaacccgg

SEQ ID NO: 358489 - DNA, 455 bp, Homo sapiens
  misc_feature: GZ8MTXP01B5O87.9.34.D01.1.454.CMB.2.raw
  modified_base (291)..(291): a, c, t, g, unknown or other
  misc_feature (291)..(291): n is a, c, g, or t
  modified_base (307)..(307): a, c, t, g, unknown or other
  misc_feature (307)..(307): n is a, c, g, or t
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
  modified_base (449)..(449): a, c, t, g, unknown or other
  misc_feature (449)..(449): n is a, c, g, or t
  modified_base (451)..(455): a, c, t, g, unknown or other
  misc_feature (451)..(455): n is a, c, g, or t
tcagtgatacgtctcacgaccggtgctcgatttagatcgtctgtgttgggtttgggggctgttcctggaagttgttggtaccagtgtcaccatctcgtgcactggaagtagctccaacatcggggcacgttatgatgtacactggtaccaacaacttccaagaacagcccccaaagtcatcatttatgacaacatgaagcggccctcgaggggtcccctgaccgattcctccggctccaagtctggcacatcacgccctccctggccatcacgtgggctccaggctgaggntggagctgactatacngccagtcgtatgacaggtggacctaagtacatcgtctcggactgggaccaggtcaacgtctggcacgcccaagcccacccnctntcactctcgtcccaccctctcagctatcgctgagccgggntcgggnaacggcgctagngnnnnn

SEQ ID NO: 358490 - DNA, 608 bp, Homo sapiens
  misc_feature: GZ8MTXP01DPPJC.9.34.D01.1.454.CMB.2.raw
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (273)..(273): a, c, t, g, unknown or other
  misc_feature (273)..(273): n is a, c, g, or t
  modified_base (315)..(315): a, c, t, g, unknown or other
  misc_feature (315)..(315): n is a, c, g, or t
  modified_base (327)..(327): a, c, t, g, unknown or other
  misc_feature (327)..(327): n is a, c, g, or t
  modified_base (519)..(519): a, c, t, g, unknown or other
  misc_feature (519)..(519): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacactatctacgcaaactccgtgagggccnctcatcatctccaganacaacttccaagaacatactgtctngacaactcaataactgagaggacgagacacgctatttattcngtgacggaaggngctagtagtagggaacttacgtattttcgacttccccgacgctgtcgactacgtttgacgttacgggtcgggggaccccgggtaccgttggtccgtccgtcctccctcgacgccctaccaaccgacgcccacgtccgtccccttccccggtcgccctaccctcctaccaacgcgccaccgtcgtcggggacncgcggcccggccgttgggccttcgtccgtggttaccgaacggttaccttaaccgttaccgaacgtacgtacttacgtccgttggaacgg

SEQ ID NO: 358491 - DNA, 661 bp, Homo sapiens
  misc_feature: GZ8MTXP01ANE5C.9.34.D01.1.454.CMB.2.raw
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgagggccnttcatcatctcaganacaatccagaacatactgtctctagcaaactactaactaaacctgaggaggcgaggacaccggtacctattttactttcgtggtacgacggaaggagacaagtagtaggggtaaacgttacgtattttcgactcccgtccgactaacgtcgactactttgtacgttacggtcgggggacccgggtacctggtccgtccgtcctcctcgaccgtccctacccgaaccgaaccgggtcccctacggttcccggttccccttcccccgggtaggtcccctaccccgtcctaccgaacgcgaccctaccgtcggtccggggacaccgcggcccggtccgttcgggccttcgggtcccgtggttaccgacggttacctaaccgttaccaacgtaacgttcacctaacgttggaaccggg

SEQ ID NO: 358492 - DNA, 663 bp, Homo sapiens
  misc_feature: GZ8MTXP01B0795.9.34.D01.1.454.CMB.2.raw
  modified_base (335)..(335): a, c, t, g, unknown or other
  misc_feature (335)..(335): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgccgccctcagtgtcgtcgggccccagggcagaggtcaccatctcgtgcacgtggaaagtgctaccaacgagtcggggcacgttatgatgtacacgtacggtaaccaaactacttaccaggaaccccacgacccccaaagtcatcgtattanacgacaacatcgaacgccggtccctcgacggggtccctgccgtacgttcctaccggctaccaagtctacggcacgatccacgtccctcccgtcggaccatccgacgtcgggccctacgacgggcgtaggaggtaacgtggacggtccgttagtactttaacgttacgtcggtacccgtaggttccgtaagttcggaacgttacgggttaccgggttaaaccttaaaacggttaaccgttcgtttaccgggttaaccggtttaaccggggtaacggttaaccgggggacccgttaaaccgggttcccggttaaccccgggtttcccggg

SEQ ID NO: 358493 - DNA, 668 bp, Homo sapiens
  misc_feature: GZ8MTXP01BNL0V.9.34.D01.1.454.CMB.2.raw
  modified_base (385)..(385): a, c, t, g, unknown or other
  misc_feature (385)..(385): n is a, c, g, or t
  modified_base (501)..(501): a, c, t, g, unknown or other
  misc_feature (501)..(501): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccgcttcatcatctccagagacaattcccagaacatactgtctctgacaactacaataacctgagaggcgaggacacggcctattttatttctgtggacggaaggtaggactagtagtaggggtaaacgttacgtattttcgacttccctccgcngtcactactttgtacgttacggcgggggacccgggtacccgtggtccgccgtctcctcgacgccctaccacgaacgggccctagtcccgggtcccttcccccgggtcggtaccccnccccgttcccgtacccgtaacgaccggaccctaacccggttccggtcgggggccaaccgcgggcccgggtcccgttcggggtccgttcggtccgttcgggttaccgaacgggttacccttaaccgttccgaacggtaccgttacgttcgtaacgttcggaacggggg

SEQ ID NO: 358494 - DNA, 615 bp, Homo sapiens
  misc_feature: GZ8MTXP01DGS3R.9.34.D01.1.454.CMB.2.raw
  modified_base (327)..(327): a, c, t, g, unknown or other
  misc_feature (327)..(327): n is a, c, g, or t
  modified_base (386)..(386): a, c, t, g, unknown or other
  misc_feature (386)..(386): n is a, c, g, or t
  modified_base (403)..(403): a, c, t, g, unknown or other
  misc_feature (403)..(403): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtcgtggggcccccagggcagaggtcaccatctcgtgcactggaaagtagctaccaacatcggggcacgttatgatgtacactgtaaccaacaacttccagaacacgaccccaaagtcatcatttatagacaanatcgaacgcgccctcgacgggtccctagccgatccgtccggctaccaagtctcggacanactcacgccctacccgnggacctatccgacgttcgggcctccgaggtcgtacggaggtacgtggacggtcctaggtaccttaacttacgtcggtaccctaaggttcgtaacgtcgaacgtacggttacggtaacccttaaaggttaaccttacgttacccggttcgtttaacccggaaccggttacgggggaacccttaacgggttcccgttaaccccgggttcccggg

SEQ ID NO: 358495 - DNA, 574 bp, Homo sapiens
  misc_feature: GZ8MTXP01CQDPR.9.34.D01.1.454.CMB.2.raw
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
  modified_base (330)..(330): a, c, t, g, unknown or other
  misc_feature (330)..(330): n is a, c, g, or t
  modified_base (456)..(456): a, c, t, g, unknown or other
  misc_feature (456)..(456): n is a, c, g, or t
  modified_base (475)..(475): a, c, t, g, unknown or other
  misc_feature (475)..(475): n is a, c, g, or t
  modified_base (532)..(532): a, c, t, g, unknown or other
  misc_feature (532)..(532): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgcccgccctcagtgtcgtcggggccccagggcaggaggtccaccatctcgtnacacgtaggaatcgcctacaacgngtcgggctacgtatgatgacactacgtaaccaactactcgaagaccacgaccccaaagtcattacatttanacaacacatacgacgcgccctacggacgggtccctagaaccgtactttccgaccggtcctacccgaagttcgcgacactctaccacgtccctacccgtgccctaatccgacgtcggcctacggacngggtaggagattaggcgtncgtaacttaagtcctgtaccgtagttcgaatcgagtacgcggtaaacctagttaacngttacgtcgttacggaacgtcgaccgttagtccaacggttcg

SEQ ID NO: 358496 - DNA, 614 bp, Homo sapiens
  misc_feature: GZ8MTXP01B143O.9.34.D01.1.454.CMB.2.raw
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
  modified_base (278)..(278): a, c, t, g, unknown or other
  misc_feature (278)..(278): n is a, c, g, or t
  modified_base (334)..(334): a, c, t, g, unknown or other
  misc_feature (334)..(334): n is a, c, g, or t
  modified_base (596)..(596): a, c, t, g, unknown or other
  misc_feature (596)..(596): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactgggagtgggtcgcaggcatcgctgggtggcggtcatgacacattctacgcaaactccgtggacggggccncttcatcatctccaganacaacttcccagaacatactgtcnctgacaactacaatacctgagaggcgagacacggctatttattcgtgtgcgaaggngcagtagtggaacgtactatttcgactccctaccgctcgtcactacgtttgacgttacggtcgggggacccgggtaacccgtcgggtccgtccgtcctccctacacgccctaccgaccgacgggcccacgtccgtcccgttccccgtcgtcccgtacccctccctaccgaacgcgacctaccgtcgtcgggggaccaccgcgcccggccggttcgggccttcgccgtcggacgttacgaccttaaccgtccaacgtaccgtnttaccgtcgttggaacgg

SEQ ID NO: 358497 - DNA, 663 bp, Homo sapiens
  misc_feature: GZ8MTXP01EP9HZ.9.34.D01.1.454.CMB.2.raw
  modified_base (237)..(237): a, c, t, g, unknown or other
  misc_feature (237)..(237): n is a, c, g, or t
  modified_base (277)..(277): a, c, t, g, unknown or other
  misc_feature (277)..(277): n is a, c, g, or t
tcagtgatacgtctcacgaccggtgctcgatttagatcgtctgtgttgggtttgggggaggcttggtccagcctgggggagtccctgcgactctcctgtgtggcctctggattcacctttgagacctatgccttgacctgggtccgccaggctccgaggggagggactgggagtgggtcgcaggcatcgctgggtggcggtcatgacacattctacgcaaactccgtggaggggccncttcatcatctccagagacaattcccagaacatactgtcnctgacaactcaataacctgagaggcgaggacacggacctattttattctgtgacgaaggaggcatagtagggtaaacgtacgtatttcgactcccctacgctggtaccgtaactacgtttagtacgtttacggtcggggggacccgggtaacccgttggggttcccgtcccgttccttcccgttacgaaccggtcccctaccgaacccggaacgggtccccctacgttcccggttccctttcccccgcgggcccctaccccctcgaaccgaacgcacctaccgtcgggccgggacaacggtccggcccggtccggttggccttccggcgtaggaaccgttacgttaccttaaccgtacgaacgttcgacttacgcgttaacgcggg

SEQ ID NO: 358498 - DNA, 630 bp, Homo sapiens
  misc_feature: GZ8MTXP01A5BYG.9.34.D01.1.454.CMB.2.raw
  modified_base (232)..(232): a, c, t, g, unknown or other
  misc_feature (232)..(232): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggcctatttattctgtgacgaaggagcatagtgggaactacgtattttcgactcccgtcgctgtcactactttgacttacggcgggggcccgggtaacctcggtccgtccgtctcctcgacgcctaccaccgaacggccctacgtccggtcccttccccggtcggccctaccccgtaccctacccgaacgacgtccgtacccgtcggtcgggggccaaccggccggcccgggtcccgttcgggccgttcggcccgttcgggttaccgttaacgggttaccttaaccttaccgaacgtacgtacttaccgtaacgttggtaaccggg

SEQ ID NO: 358499 - DNA, 611 bp, Homo sapiens
  misc_feature: GZ8MTXP01EXK8K.9.34.D01.1.454.CMB.2.raw
  modified_base (326)..(326): a, c, t, g, unknown or other
  misc_feature (326)..(326): n is a, c, g, or t
  modified_base (362)..(362): a, c, t, g, unknown or other
  misc_feature (362)..(362): n is a, c, g, or t
  modified_base (428)..(428): a, c, t, g, unknown or other
  misc_feature (428)..(428): n is a, c, g, or t
  modified_base (549)..(549): a, c, t, g, unknown or other
  misc_feature (549)..(549): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtcgtggggccccagggcagaggtcaccatctcgtgcacgtggaagtagctccaacagtcggggctacgttatgatgtacacgtacgtaaccaacaactccaaggaacacgacccccaaagtcatctattanagacaacatcgaacgcggccctcgaccggggtcccncgaacccgtattcctcccggctcccgaagtctcggacactatccacgtccctcccgtcggccctanccacgtcgggcctaccgacggcgtgggaacgggatacggacggtcgtacgtacttaacgttccgtacgcccgtagttccgttaagacggttacaggttacggaccgttaaaagttaccttnttccggttaaccttacgggaacgttaccggggacttaacgggtcccgttaaccggttccggg

SEQ ID NO: 358500 - DNA, 671 bp, Homo sapiens
  misc_feature: GZ8MTXP01A9PLS.9.34.D01.1.454.CMB.2.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (276)..(276): a, c, t, g, unknown or other
  misc_feature (276)..(276): n is a, c, g, or t
  modified_base (339)..(339): a, c, t, g, unknown or other
  misc_feature (339)..(339): n is a, c, g, or t
  modified_base (383)..(383): a, c, t, g, unknown or other
  misc_feature (383)..(383): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactgggagtgggtcgcaggcatcgctgggtggcggtcatgacacattctacgcaaactccgtgacggggccncttcatcatcncaganacaacttcccagaacatactgtcnctgacaactcaaataacctgagaggacgaggacacggactatttattcgtgtagacggaaggngactagtagtaggtaacgtacgtatttcgacctcccgtccgacngtacgaacttacgttgtacgttacgggtcgggggtaccccgggtaacccgttggtccggtcccgttcctcccgtcaccgccctacccgaaccgtacgggaccctacgtccgggttcccctttccccggcggtacccctaacccctcctacccgaacgtacgaccctaccgttccggtacgggggccaccgccgggcccgggtcccgttgggggccttcggtcccgtcggttaccgacgggttaacctccgttaccgaacgtacggtacaccgtaagttcggaacgggg

SEQ ID NO: 358501 - DNA, 644 bp, Homo sapiens
  misc_feature: GZ8MTXP01BWS8R.9.34.D01.1.454.CMB.2.raw
  modified_base (261)..(261): a, c, t, g, unknown or other
  misc_feature (261)..(261): n is a, c, g, or t
  modified_base (340)..(340): a, c, t, g, unknown or other
  misc_feature (340)..(340): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgcccgccctcgagtcgtcgtcggggccccagggcaggaggtccacatctcgtgcacgtaggaaagtgacctacaacgngtcgggactacgttatgtatcgtacacgtcgtaccaaactactaccgaacgaaccacgaccccaagtcatactatttanagaacaacagtacgaacggtccggacccgtacggaccggggttcccctacggtaacccgtacttcccgtcccgggtacctaccgtaacgtcgtacggcctactacgtccacgccccttcccgacgtccatccgacgtcgggctcgacggcgtaggacggttaacgggtaggtctaggtacttacgttaccgtacgccgttaagttccgtaagtacgacgtagttacgtaaactaaggttaaacttcgttacggttaacgtaacggtaacggtacggaccttaacgggtcccgccggttaaccgg

SEQ ID NO: 358502 - DNA, 756 bp, Homo sapiens
  misc_feature: GZ8MTXP01DTCX0.9.34.D01.1.454.CMB.2.raw
  modified_base (233)..(233): a, c, t, g, unknown or other
  misc_feature (233)..(233): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccnttcatcatctccagagacaattcccagaacatactgtctctgacaactcaataacctggagaggacgaggacacggtacctattttattctgtgacgaaggagcatagtaggtaacgtacgtatttcgactccccgtccgactcgtccgtaactacgtttcgtaacgttaccgggtcgggggtaccccggggtaacccgttcgggtcccggtcccggttcctccccgttacgaccgtaccccgtacccaaccccggaaacggggccccctacggttccccgggttccccctttccccccggggtccgggtacccctaaccccccttcccgtaaccccgaaacggtacccgacccgtaccccggttcggggttcgggggacccaacccggtacgggccccggggtccccgttcggggggtcccttccgggtacccgttcggggacccgttaaaacgggttacccttaaccctttacccggaacgggttaaccttacgttaccgtaacgggttcggaaccggggg

SEQ ID NO: 358503 - DNA, 724 bp, Homo sapiens
  misc_feature: GZ8MTXP01A6FPO.9.34.D01.1.454.CMB.2.raw
  modified_base (232)..(232): a, c, t, g, unknown or other
  misc_feature (232)..(232): n is a, c, g, or t
  modified_base (270)..(270): a, c, t, g, unknown or other
  misc_feature (270)..(270): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggaggactggagtgggtcgcaggcatcgctggtggcggtcatgacacattctacgcaaactccgtgaggggccnttcatcatctcagagacaatcccagaaccatactgtcnctgacaactacaaatacctgaaggagcgtaggaccacggaccttattttatttcgtggtacggtaacggaagggacgtacaagttaggtaaggggtaaacgttaccgttatttaccgaccttcccgtaaccgctaagtaccgaacttacgtttagtacggtttacggggacgggggaccccgggtaacccgtcggtaccgtcccgtccgtccctagacccgtccccgttacccgaaccggtaaaccggccccgtaacgttccccggttaccccttcccccgggttccggacccgtacccctaccctaccaacggtacccgacgtacccgttcgggtccggggaccaaccggccgggcccgtcccgggttcgggtcttccggtacgtaccggttaacgacggttaccgttaaccttccgaacgtacggtattacccgtaacgttcggaaccgggg

SEQ ID NO: 358504 - DNA, 734 bp, Homo sapiens
  misc_feature: GZ8MTXP01DLSRD.9.34.D01.1.454.CMB.2.raw
  modified_base (235)..(235): a, c, t, g, unknown or other
  misc_feature (235)..(235): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggaggtgggtcgcaggcatcgctggtggcggtcatgacacattctacgacaaactccgtgacgggccncttcatcatctccagagacaacttcccaagaacatactgtctctgacaactacaaataacctgagaggcgaggacacggctatttattctgtgacggaaggagacaagtagtagggtaaacgttacgtattttacgaccttccccgtaccgacgtaacgtaccgtaacgttaacgttttaggtaaccgtttacggggtaccggggggtacccccggggtaacccgttcggggtcccggtccccgttccttcccgtacccgaccgtcccctacccgaacccgaaccgggcccctaccgttcccggttccccgttcccccggtcggacccctacccccttacccgtacccgaaacgccgtacccgtacccgtcgggtcgggggacccaccggacgggcccgggtcccggttcggggtccttccggtacccgtacgggttaccgaacgggttaccttaacccttacgaacgtacgtacgttaccgtaacggttcggaacggg

SEQ ID NO: 358505 - DNA, 621 bp, Homo sapiens
  misc_feature: GZ8MTXP01BUYNY.9.34.D01.1.454.CMB.2.raw
  modified_base (234)..(234): a, c, t, g, unknown or other
  misc_feature (234)..(234): n is a, c, g, or t
  modified_base (285)..(285): a, c, t, g, unknown or other
  misc_feature (285)..(285): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacatattctacgcaaactccgtgacggggccncttcatcatctccagagacaacttcccagaacatactgtctctgacaactnaataacctgagaggcgagacacggtctattttattcgtggtgacggaaggagctaagtagtaggggtaaacgtacgttattttccgaaccttccccgttaccgactaacggtcgtaaacttacgtttaggtacgtttaacgggcggggggacccgggtaacccgtggtccgtccggtcctccttcgacgtccctaccaccgacgggcccacgttccgtcccttcccggtcgtccctccctcctacgaacgcgacctaccgtcgtcggggcacgcggccgcccgttggccttcgcgtgttacgacgttactcttcgaagtcgcttacgtgttggcgg

SEQ ID NO: 358506 - DNA, 648 bp, Homo sapiens
  misc_feature: GZ8MTXP01A28LZ.9.34.D01.1.454.CMB.2.raw
  modified_base (192)..(192): a, c, t, g, unknown or other
  misc_feature (192)..(192): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgccgccctnagtcgtcgtcggggcccagggcaggacggtcaccatcgtcgtgcacgtggaagtagcctacaacagtcgggactacgttatgatcgtacacgtacgtaaccaaactaactaccgaagaaccaccgaccccctaaagtcattactaattatacgaacaaacagtaccgaacggccggtacccgtcgaccggggtaccctacggaacccgttacgttcccgtcccggacctaccgaacggtctcggaccactaactccgacgtacccctccgtacggcctaacgtccgaccggtcgggtaccctacgacgggtcgtagggaacggtacgttagggacgtcgtacgtaaactttacgttaccgcgtaccgtaggtccgtaagtggaacgtacggttcggaaaccgtaaagttacgttcgttcgtaacgtacgaacgtacggacacggtccgaaccgtcg

SEQ ID NO: 358507 - DNA, 584 bp, Homo sapiens
  misc_feature: GZ8MTXP01E0XKX.9.34.D01.1.454.CMB.2.raw
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (453)..(453): a, c, t, g, unknown or other
  misc_feature (453)..(453): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtcgtcggggccccagggcaggaggtcaccatctcgtgcacgtggaagagctccaacagtcggggcacgttatgatgtacactacggtaccaaacaacttccaaggaaccacgaccccccaaagtcatctatttatcgaacaacatcgaacgcggccctcgcgggtcccngccgtatccnccggctccgaagtcgtggccacactcgacgccctccctcggacctactccacggtcggcctaccgaggcgtggagggtntcgggaggcgtagtaccttacgttacgtgtaccctacggttctaagtgacgtaggttacggaccgtaaagaacgttcgttccgttcgtacggtaacgtacgggaccgttacggtccgttaacccggtccgg

SEQ ID NO: 358508 - DNA, 688 bp, Homo sapiens
  misc_feature: GZ8MTXP01EMIT2.9.34.D01.1.454.CMB.2.raw
  modified_base (144)..(144): a, c, t, g, unknown or other
  misc_feature (144)..(144): n is a, c, g, or t
  modified_base (301)..(301): a, c, t, g, unknown or other
  misc_feature (301)..(301): n is a, c, g, or t
  modified_base (345)..(345): a, c, t, g, unknown or other
  misc_feature (345)..(345): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccnccaggctccgaggggagggactgggagtgggtcgcaggcatcgctggtggcggtcatgacacattctacgacaaacgtccgtggacggggcctcttcatcatctaccagagactaacttcccagaacatactgtctctgacaaactcaaataaccgngagaggcgaggacacggcctatttacttcgtgtgacggaaaggngtacagtagtaggtaacgtacgtatttcgacttcccctacgactcgtctaactactttaggaactttaccggggcgggggtacccggggtaacccgtcggtccggtccgtcgtccctacgaccgtccccgtaccgaccgaacgggccctacggttccggttccccgttccccgggtcggtcccctaacccctcccgttaccgaacggaccgtaccgtacccgtccgggtcgggggacctaaccgccgggcccgggtcccgttcgggtccgttcgccggttcggttaccgttacggttacgttaacctaccgaacgttaacggtcaccgtaacgcggtaacggg

SEQ ID NO: 358509 - DNA, 774 bp, Homo sapiens
  misc_feature: GZ8MTXP01BFH0T.9.34.D01.1.454.CMB.2.raw
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
tcagtgatacgtctcacgaccggtgctcgatttagatcgtctgtgttgggtttgggggaggcttggtccagcctgggggagtccctgcgactctcctgtgtggcctctggattcacctttgagacctatgccttgacctgggtccgccaggctccgaggggagggactggaggtgggtcgcaggcatcgcgtgggtggcggtcatgacactattctacgacaaactccggtggacgggccncttcatcatcncagagacaacttcccaagaacatactgtctctcgactaactacaaataacccgtggaaggaggacggaaggaccgacggccttaattttactttcgtggtaggaggtaaacggaggtactagtaaggtagggtaaacgttacgttacgtttttcgaccttccccgtaccgacaacggttccaaccttacgtttacggtaacgtttacggggtacggggggtaccccgggtacccgttcggggttcccgcccgttccgttcccgtaccgtaacccgtcccctacccgaacccggaaccggggtacccctacgttcccgggttccccctttacccccggggtcggtaccccctaccccttacccgtaacccgtaacgaccgtccctaacccggtcgggtaccgggggaccaccgggccgcccggggtccgttcggggtcccgttcggccgttacggacgttaaccggttaccttaaccttcccgaagttacccgtacgttacccgtaacggttcggtaacgggg

SEQ ID NO: 358510 - DNA, 747 bp, Homo sapiens
  misc_feature: GZ8MTXP01CGSPH.9.34.D01.1.454.CMB.2.raw
  modified_base (193)..(193): a, c, t, g, unknown or other
  misc_feature (193)..(193): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacgagggtcctgggcccagtctgttctgacgcacgccgccctnagtcgtcgtcggggccccagggcaggacggtccaccatctcgtgcacgtagggaagtacgcctaccaaacgcggtcgggactacgttatgaatcgtacacgtacgtaacccaaactaccttaccgaacggaaccaaccgaaccccctaaagtctaactttacgtaatttttaacgacgaaacaaacgtaacgttaccggaaaccggtccggtaccccgttacggtaaccgggggttacccccttacgggtaacccgttaacgtttccccggacccgggtacctaaccccgaaaggttccgtacggacctactaacttccgacccgtcccgttcccgtcggtaccctaactccgaaccgtcgggtacctacgacggtacgtagggtaacggtagtacgggtacggtaccttaagttaacctttaacgttaccgtaccggtaccgttaaggttccgtaagtttacgacggtacgttacggtaaacgttaacgttaaacgttcgttcgttaacgtaacggaacgtacgggaacgttacgtaacccgttcgtaaccgg

SEQ ID NO: 358511 - DNA, 620 bp, Homo sapiens
  misc_feature: GZ8MTXP01ALNJJ.9.34.D01.1.454.CMB.2.raw
  modified_base (233)..(233): a, c, t, g, unknown or other
  misc_feature (233)..(233): n is a, c, g, or t
  modified_base (273)..(273): a, c, t, g, unknown or other
  misc_feature (273)..(273): n is a, c, g, or t
  modified_base (291)..(291): a, c, t, g, unknown or other
  misc_feature (291)..(291): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccagaacatactgtcnctgcaactacaataaccngagaggcgagacacggcctatttattcngtgcgaaggngcagtagtgggaactacgtattttcgactcccctaccgcaagtcgaactacgtttgacgttacggcgggggacccggggtaccctgggtccgccgtacctccctcgaccgccctacccaccgaacgggtccccagttccggtccttcccgtcttcggcctaccccgtccctaccgaacgcgcctaccgtcgacgggggccacgaacggtcccggccgtcggggctacggtccttcgggttccaacgggtaactacccgttccgaaggaccgttactaaccgcgtaacgggg

SEQ ID NO: 358512 - DNA, 598 bp, Homo sapiens
  misc_feature: GZ8MTXP01D47UM.9.34.D01.1.454.CMB.2.raw
  modified_base (248)..(248): a, c, t, g, unknown or other
  misc_feature (248)..(248): n is a, c, g, or t
  modified_base (302)..(302): a, c, t, g, unknown or other
  misc_feature (302)..(302): n is a, c, g, or t
  modified_base (346)..(346): a, c, t, g, unknown or other
  misc_feature (346)..(346): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgaggggagggactgggagtgggtcncaggcatcgctgggtgcggtcatgacacattctacgcaaactccgtgagggccncttcatcatctccagagaacaattcccaagaacatactgtctcngcaacctcaaataacctgaagaaggcgaagggacacgggcctaatttattctgtagacgaaggaggcaatagtagggaaagttacgtacttttacgactcccctcgcacgtcggtactactttgacgttacggtcggggtacccggggaaccctcgggtccgtcccggtcctcctccaacgcccttaccgaccgaacggcccacgttccggttcccttccccgcgccaaccctccacaacgcgccgtaaccg

SEQ ID NO: 358513 - DNA, 504 bp, Homo sapiens
  misc_feature: GZ8MTXP01E5SDN.9.34.D01.1.454.CMB.2.raw
  modified_base (208)..(208): a, c, t, g, unknown or other
  misc_feature (208)..(208): n is a, c, g, or t
  modified_base (484)..(484): a, c, t, g, unknown or other
  misc_feature (484)..(484): n is a, c, g, or t
  modified_base (487)..(504): a, c, t, g, unknown or other
  misc_feature (487)..(504): n is a, c, g, or t
tcagtgatacgtctcacgaccggtgctcgatttagatcgtctgtgttgggtttgggggctgttcctggaagttgttggtaccagtgtcaccatctcgtgcactggaagtagctccaacatcggggcacgttatgatgtacactggtaccaacaacttccaggaacagcccccaaaagtcatcatttatgacaacatgaagcggccctnaggggtcccctgaccgattctccggctccaagtctggcacatcagcctccctggccatcactgggctccaggctgaggatgaggctgactattactgccagtcgatgacagtgcctaagtaacatcgtcttccggaacgtagggaccaaaggtccaacccgtacccgtggggtacacgacccaacgggccctaaacccccatcgtcactactcgttccccacccctcccgttcagacgtatacaccgtgagcgggcggtggcgaaacggcgccaanagnnnnnnnnnnnnnnnnnn

SEQ ID NO: 358514 - DNA, 636 bp, Homo sapiens
  misc_feature: GZ8MTXP01AGLAM.9.34.D01.1.454.CMB.2.raw
  modified_base (343)..(343): a, c, t, g, unknown or other
  misc_feature (343)..(343): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgcccgcctcagtgtcgtcggggccccagggcaggacggtcaccatctcgtgcacgtaggaagtacgctaccaacaggtcggggactacgttatgatacgtacacgtacggtaacccaaacaactaccgaacgaaccacgaccccaaagtcatctatttanacgaacaacagtacgaacggccggccctacgaccgggtccctacgccgtacttcccgccggtcctaccgaagtcgtacgacacgtactacgaccgtccctcccgtaggacctaacgtccgacgtcgggacctacggaggccggttaggaacggtagtacggacggtactcggtaacttacgttacgtcgtaccgtacgttcggtaactcgttacgtacggttacgtaaccgtaagttacgttcgttcggtaaccgtacggaacgtacgggacgttacgtccgccggttaaccg

SEQ ID NO: 358515 - DNA, 645 bp, Homo sapiens
  misc_feature: GZ8MTXP01D7PI5.9.34.D01.1.454.CMB.2.raw
  modified_base (331)..(331): a, c, t, g, unknown or other
  misc_feature (331)..(331): n is a, c, g, or t
tcagtgatacgtctcacgaccggtgctcgatttagatcgtctgtgttgggtttgggggaggcttggtccagcctggggacgtccctgcgactctcctgtgtggcctctggattcacctttgagacctatgccttgacctgggtccgccaggctccgaggggaggactggagtgggtcgcaggcatcgctggtggcggtcatgacacattctacgcaaactccgtgaggggcctcttcatcatctccagagacaacttcccagaacatactgtctctgcaactacaatacctgagaggcgaggacaggcctatttattctagtgacgaaggngacatagtaggaatacgtattttcgactcccgtacgctgtcgacctactttgactttacgggtcgggggtacccgggtaccttgggtccgtccgtctacctcaacgccctaccgaccgtaacgggccccaacgttcggtcccctttccccggtcggtccctaccccgtccctaccaaaccgggctaccgaacccgttccggtcgggggacaccgaggcccggtccggttgggcccttacggcccgttagggttaccgaagggttccctaacctttacccgcgtacgtaacgttcctaacggttaaggcccgggg

SEQ ID NO: 358516 - DNA, 684 bp, Homo sapiens
  misc_feature: GZ8MTXP01A66PZ.9.34.D01.1.454.CMB.2.raw
  modified_base (271)..(271): a, c, t, g, unknown or other
  misc_feature (271)..(271): n is a, c, g, or t
  modified_base (312)..(312): a, c, t, g, unknown or other
  misc_feature (312)..(312): n is a, c, g, or t
  modified_base (399)..(399): a, c, t, g, unknown or other
  misc_feature (399)..(399): n is a, c, g, or t
tcagtgatacgtctcacgaccggtgctcgatttagatcgtctgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctctggacagtcgatcaccatcctctgcactggaaccagcagtgagttggttgggattatgtaccttgtctctggaaccaanacgaccaccgaggaccaaacgacccccaaatcatctattangagtcaactagccgcctgtagggtttctattcgtcttctcgtcgctacaagtctgacaacgcgtcctctagacatctcgtggctcgnggctagggacgacgaggtcttagtactttagttacctggtcgttcggtaccttacctaagttaccgttaggtaccgtaaagggtccgtttagggggtaacctaccccgttaaccccggggttaaccccggggtttaaggggtttaccgggttacccggggaaccgggggtaaacggggtaaacccggttaaacgggggttcccgttaaccccgggttaaccggtaccggtaacccgaacccggaaccccggttacgggttccccgttaaccccggttccccccgg

SEQ ID NO: 358517 - DNA, 687 bp, Homo sapiens
  misc_feature: GZ8MTXP01CKSDQ.9.34.D01.1.454.CMB.2.raw
  modified_base (196)..(196): a, c, t, g, unknown or other
  misc_feature (196)..(196): n is a, c, g, or t
  modified_base (285)..(285): a, c, t, g, unknown or other
  misc_feature (285)..(285): n is a, c, g, or t
  modified_base (359)..(359): a, c, t, g, unknown or other
  misc_feature (359)..(359): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacgacgggtcctgggccctagtctgttctgacgcacgcccgccctnagtcgtcgtcgggcccagggcaggacggtccacatctcgtgacacgtaggaaactcgcctaccgaacgtcggtcggggactacgttagngatacgtacaccgtacgtaacccaaactaacctaccgaacgaccaaccgaccccaaagtccattacgtatttanacgaacatagaccgacgccgaccgtacggacggtccctacgaacctacgttcccgccggacctacgtaacgtccgtagacctacacgtccaccgtcccttccgtacggaccctgttaccgaccgggttccgaccgttacggacgggttaccgagggaaacgggggtcctaggtcttaagttaacctttgttaccgtggtacctagtctaactaaggttacagtagttacgttacgggaacgttccgttacccggttacccggtttccgggtaggtttaaccggccgggggtaacgggttaacggtaacccgttaacggggttaacccg

SEQ ID NO: 358518 - DNA, 671 bp, Homo sapiens
  misc_feature: GZ8MTXP01C4ATV.9.34.D01.1.454.CMB.2.raw
  modified_base (244)..(244): a, c, t, g, unknown or other
  misc_feature (244)..(244): n is a, c, g, or t
  modified_base (308)..(308): a, c, t, g, unknown or other
  misc_feature (308)..(308): n is a, c, g, or t
  modified_base (324)..(324): a, c, t, g, unknown or other
  misc_feature (324)..(324): n is a, c, g, or t
  modified_base (342)..(342): a, c, t, g, unknown or other
  misc_feature (342)..(342): n is a, c, g, or t
  modified_base (596)..(596): a, c, t, g, unknown or other
  misc_feature (596)..(596): n is a, c, g, or t
  modified_base (602)..(602): a, c, t, g, unknown or other
  misc_feature (602)..(602): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggagggactggagtggggtcgcaggcatcgctgggtgggcggtcatgaacactattctaacgacaaactccgtggacgggggccncttcatcatctcagagacaattcccaagaacatactgtcctctgacctaactacaaattaaccnggagaggcgaaggacncggactatttacgtttcngtcgaggaaggaggctaagtaagtagggaaacgttactagtttttaccgactcccccgtcgacaaggttaccaaactacgttttgaactttacggggtcgggggaccccggggaaacccgtcggtccgtcccgtcctccgttcacgccctaccgacccgtaacgggcccacgtccgtcccttccccggtcggccctaccctccctaccaacggacacctacccgtacgtcggggaccaccgacggcccgtccgngggtcncggtcccgtaggaccgttaacggacccttaacggttaccaacggaccttacgccgtaacgttcggaacg

SEQ ID NO: 358519 - DNA, 669 bp, Homo sapiens
  misc_feature: GZ8MTXP01A4JAK.9.34.D01.1.454.CMB.2.raw
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggagggactgggagtgggtcgcaggcatcgctgggtggcggtcatgacacattctacgcaaactccgtggaggggccncttcatcatctccaganacaacttcccagaacatactgtctctgactaactacaaataaaccgtgaggaggacgaggacacggacctattttatttctgtgacggaaggagcaagtagtagggtaacgttacgtatttcgactccctaccgctaagtccgtactagtttacgtacgttacgggtcggggggtaccccgggtaacccgtcgggtcccgtcccgtctaccctcaccggtccctaccaaccgaccgggtcccctacgtcccgttccccttcccccggtcggtcccctaccccgtcccgtacaacgcacccgaccgtcggtacggggccaccgcgggcccggtccgttcggggtccttcggccgttgggaccgacgggttacttaaccgttccgaacgtatacgttacgtaaccgttggaaccggg

SEQ ID NO: 358520 - DNA, 559 bp, Homo sapiens
  misc_feature: GZ8MTXP01BKLZT.9.34.D01.1.454.CMB.2.raw
  modified_base (237)..(237): a, c, t, g, unknown or other
  misc_feature (237)..(237): n is a, c, g, or t
  modified_base (351)..(351): a, c, t, g, unknown or other
  misc_feature (351)..(351): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
  modified_base (480)..(480): a, c, t, g, unknown or other
  misc_feature (480)..(480): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactgggagtgggtcgcaggcatcgctggtggcggtcatgacactattctacgacaaactccggtgaggggccnttcatcatctcagagacaacttcccaagtaacatactgtactctgactaactacaactaacctgaaggaggacgaggaaccacggacctattttacttcgtgtcgacgaagggnggcagtagtagggaacttacgtatttcgactccctacgctgtcgactatttgatttcggcggggccggtaccgtgcncgtcncncncncncacgacgcactcgtcctccgcnccgcccnctacacgacncaccgtcgtcgggcacgcgccgccgttcggcttcgcgtgttacgcgacgtaactcaacgtcattctaacgttggaacgg

SEQ ID NO: 358521 - DNA, 754 bp, Homo sapiens
  misc_feature: GZ8MTXP01BPMI7.9.34.D01.1.454.CMB.2.raw
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
  modified_base (282)..(282): a, c, t, g, unknown or other
  misc_feature (282)..(282): n is a, c, g, or t
  modified_base (303)..(303): a, c, t, g, unknown or other
  misc_feature (303)..(303): n is a, c, g, or t
  modified_base (318)..(318): a, c, t, g, unknown or other
  misc_feature (318)..(318): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgcgtgggtggcggtcatgacactattctacgcaaacctccgtggacggggccncttcatcatctaccaganacaacttcccaagaacatactgtcnctgacaactagaactaaccgngagaggcgacggacncggtactatttactttcgtaggtacgacggaaggaggactaagtacggtagggtaaacttacggtagttttccgaaccttccccgtccgcgtaacgtcgaccttacgtttacgacgtttacggggcggggggtaccccgggtaaccttcggggtccgtcccgtcctcccgtacgtaaccggtccccttaccgaacccggaaaccgggtccccttaacggttccccgggtcccccgtttaccccgggtcggtaacccctaccccgttacccgtacccgtaaacgcccgtaaccctacccgggtcggggttccgggggaacctaacgccggggtccccgcccgggttcgggtaccttccgggaccgtttaacgggttaaccgaggttacccttaacttaccggaacgtaacgttcttcgtccggttaagggtcccggg

SEQ ID NO: 358522 - DNA, 743 bp, Homo sapiens
  misc_feature: GZ8MTXP01BT0JO.9.34.D01.1.454.CMB.2.raw
  modified_base (303)..(303): a, c, t, g, unknown or other
  misc_feature (303)..(303): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactgggagtgggtcgcaggcatcgctgggtggcggtcatgacactattctaacgacaaacgtccgtggacggggtcctcttcactcatctacagagaactaacttacccaagaacattactcgtctctagactaactanaactaacctggagacggacgagtaaccgacggtaccttattttacgtttcgtaggtacgaacggtaaggagtactaagtaggtaggtaaacggttacgttaacttttcggaccttccccgtaccgacgtaaggtacctaacgtttactttacggtaacgttacggggtacgggggacccgggtacccgtcgggtccgtccgtcctccttcgaccgtacccacccgtaaccggaccggtaccctacgttcccggtttcccccgttaccccgggtaccggtaccccttaccccgtaccccgttaccgaaccggaccgtcccgtaaccggttcggtccgggggaccaaccggtccgggcccggtccgttcggtcttcgtaccgtcgttaacgacggttacctaacgtaccgaacgacgtacgttacgtaacgttcgggaacgg

SEQ ID NO: 358523 - DNA, 628 bp, Homo sapiens
  misc_feature: GZ8MTXP01CEIVM.9.34.D01.1.454.CMB.2.raw
  modified_base (305)..(305): a, c, t, g, unknown or other
  misc_feature (305)..(305): n is a, c, g, or t
  modified_base (406)..(406): a, c, t, g, unknown or other
  misc_feature (406)..(406): n is a, c, g, or t
  modified_base (588)..(588): a, c, t, g, unknown or other
  misc_feature (588)..(588): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgaggggagggactgggagtgggtcgcaggcagtcgctggtggcggtcatgacacattctacgcaaactccgtgacggggccncttcatcatctccagagactaatcccagaacatactgtctctgctaacctcaataacctgagacgggacgaaggacaccgggtctaatttattctagtcgngaaggaggcagtagtcgggtaagtaccgtatttcgacttccccgtacgtactacgtacgggtaacttactttacgtaacttaccggtcggggtacccggggtaaccgttcgggtaccgtcccggtctccctcgaacgtcccgttccaaccgacgggccctcgttaccggttccttcccccgnggtccctaaccccgtcctacccaacgtcggcctaacccgg

SEQ ID NO: 358524 - DNA, 650 bp, Homo sapiens
  misc_feature: GZ8MTXP01BXYX8.9.34.D01.1.454.CMB.2.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (280)..(280): a, c, t, g, unknown or other
  misc_feature (280)..(280): n is a, c, g, or t
  modified_base (513)..(513): a, c, t, g, unknown or other
  misc_feature (513)..(513): n is a, c, g, or t
  modified_base (642)..(642): a, c, t, g, unknown or other
  misc_feature (642)..(642): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctgggtggcggtcatgacanattctacgacaaactccgtgacgggccnttcatcatctaccagagacaacttcccagaacagtacctgtctcngacaactacaaagtacctgagaggcgtaggacaccggctattttattctgtcgacggaaggacgtactaatagtagggtaaaccgttacgttaattttcggacctcccgtaccgcgtaagtcgtacgtactttagattacgggacgggggtacccggtacccgtggtcccgcgtacctcgtacacgtccctaccgacgtaacgggcccctagttccgtcccctttaccccggngacccgtaccccttcgacccaacggccaccgaccccgttggtaccggggcaaacggcggcccgtccccgttaggggcttcgccgtaagggttcaagggttcctaaccttgaacgagtacttcaaggttnaaccgggg

SEQ ID NO: 358525 - DNA, 541 bp, Homo sapiens
  misc_feature: GZ8MTXP02IHT28.9.34.D01.1.454.CMB.2.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatggaagtacgattttcgatccctcgcagtcgacactttgattacgtgggggcccgggaacctggtccgccgtctcctcagccctcaccgaacgggcccatccggtccttcccccgtggccacccctctcccaagcgccacctcgtgggggcacgcgccggcctgggctgcctggtacaagactaactccagtacgtatcactgacgg

SEQ ID NO: 358526 - DNA, 544 bp, Homo sapiens
  misc_feature: GZ8MTXP02J25F5.9.34.D01.1.454.CMB.2.raw
  modified_base (366)..(366): a, c, t, g, unknown or other
  misc_feature (366)..(366): n is a, c, g, or t
  modified_base (395)..(395): a, c, t, g, unknown or other
  misc_feature (395)..(395): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccaggggagggactggagtgggtcgcaggcatcgctggtgcggtcatgacacattctacgcaaactccgtgaggggccgcttcatcatctccagagacaattcccagaacatactgtctctgcaacctcaatacctgagaggcgnggacacggccatttattctgtgcgaaggnggcatatgggagtacgatttcgactccctcgcagtcgacactttgattacgtggggccggggtaacctggtcgccgtctcctcacgcctccaccgaaggcccactccggtccttcccccgcggccaccctcctaccacgacgctacccg

SEQ ID NO: 358527 - DNA, 589 bp, Homo sapiens
  misc_feature: GZ8MTXP02G7J2P.9.34.D01.1.454.CMB.2.raw
  modified_base (362)..(362): a, c, t, g, unknown or other
  misc_feature (362)..(362): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcngtcgactactttgattacgtggggcccggggaacccgtggtccgccgtctccctcacgccctccaccgaacgggcccacgtccggtccttcccccgtcggcccacccctccctaccaacgacgccacccgtcgtcgggggaccacgacggccggcccgtgggcctcggcccgtcggtaccgaacggtacctaaccgttccgacgtaccgtactccaacgtcgacggg

SEQ ID NO: 358528 - DNA, 492 bp, Homo sapiens
  misc_feature: GZ8MTXP02FRXRF.9.34.D01.1.454.CMB.2.raw
  modified_base (317)..(317): a, c, t, g, unknown or other
  misc_feature (317)..(317): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
  modified_base (462)..(462): a, c, t, g, unknown or other
  misc_feature (462)..(462): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagccccaaagtcatcatttangacaacatcgaacgcgccctcgacggggtccctgaccgattctccggctccaagtctggcacatcagccctccctgccatcacgtcggctccgaggctgagatgagctgactntacngcagtcgtatgacagtgacctaagtacntcgtgtacgaactcggacaaggtcacgtcg

SEQ ID NO: 358529 - DNA, 583 bp, Homo sapiens
  misc_feature: GZ8MTXP02H49QC.9.34.D01.1.454.CMB.2.raw
  modified_base (229)..(229): a, c, t, g, unknown or other
  misc_feature (229)..(229): n is a, c, g, or t
  modified_base (358)..(358): a, c, t, g, unknown or other
  misc_feature (358)..(358): n is a, c, g, or t
  modified_base (410)..(410): a, c, t, g, unknown or other
  misc_feature (410)..(410): n is a, c, g, or t
tcagtgatacgtctcacgaccggtgctcgatttagatcgtctgtgttgggtttgggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactcgtgagggccncttcatcatctcagagacaattcccagaacatactgtctctgcaactcaaataacctgagaggcgaggacacggccatttattctgtgcgaaggagcatagtgggaatacgtattttcgatccctcgcngtcgacactttgattacggtcggggaccggggaaccctggtcgccgtctccncacgcctccaccgaacgggcccagtccggttccttccccctagggtcccacccctcctacccgaagacgcctaccgtcgcgggggcacgacggcggcccgttggggcctcggcccgtcgggtaccaaacggtaccttaaccgttcgaacgacggtatacccgtaactggacgg

SEQ ID NO: 358530 - DNA, 561 bp, Homo sapiens
  misc_feature: GZ8MTXP02FYV0Y.9.34.D01.1.454.CMB.2.raw
  modified_base (362)..(362): a, c, t, g, unknown or other
  misc_feature (362)..(362): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcngtcgacactttgattacgtgggggcccggggaaccctggtcgccgtctcctcacgcctccaccaacgggcccatccggtccttccccctcggccacccctcctacccaacgacgccaccctcgtcgggggccacgacgccggccctggggcctcgccgtcggtcaacggactaacgttccagaccgtatcacgtgacgg

SEQ ID NO: 358531 - DNA, 563 bp, Homo sapiens
  misc_feature: GZ8MTXP02JI45M.9.34.D01.1.454.CMB.2.raw
  modified_base (264)..(264): a, c, t, g, unknown or other
  misc_feature (264)..(264): n is a, c, g, or t
  modified_base (319)..(319): a, c, t, g, unknown or other
  misc_feature (319)..(319): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacagtcggggcacgttangatgtacactggtaccaacaacttccaggaacacgaccccaaagtcatcatttangacaacatcgaagccgccctcgacggggtccctgaccgattcctccggcctaccgaagtcctggaccacactcacgccctcccgtcggcccatccacgtcgggcctccgaggctggaggatggagcgtgacttattactcgacctagtcgtagtcgactaggtcggaccttaaacgtaaacctcttcggtccgttaccggaaacgttacggggaacccgtaaacggtcccgaacccgtttccgg

SEQ ID NO: 358532 - DNA, 526 bp, Homo sapiens
  misc_feature: GZ8MTXP02JL63J.9.34.D01.1.454.CMB.2.raw
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctgggccccagggcagagggtcaccatctcgtgcactggaagtagctccaacagtcggggcacgttatgatgtacacgtagtaccaacaacttccaggaacacgaccccaaagtcatctatttatgacaaacatacgaagccggaccctcgacggggtccctagacccgtattccgtcccgggcctacccgaagtccgtgggaccactatccacgccctccctggcccatcacgtgggcctccgagctggagatggaggcagactatactgccagtcgtatgacagtgacctaagtacatcgtctacggaactgggaccacggtcacgtcg

SEQ ID NO: 358533 - DNA, 537 bp, Homo sapiens
  misc_feature: GZ8MTXP02HC49V.9.34.D01.1.454.CMB.2.raw
  modified_base (317)..(317): a, c, t, g, unknown or other
  misc_feature (317)..(317): n is a, c, g, or t
  modified_base (530)..(530): a, c, t, g, unknown or other
  misc_feature (530)..(530): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccgcttcatcatctccagagacaattcccagaacatactgtctctgcaactcaaataacctgagaggcgaggacacggccatttatttcngtgcgaaggaggcatatgggaatacgattttcgatccctcgcagtcgacactttgattacgtggggcccgggaaccctggtcgccgtctccctcacgccctccaaccaacgggcccagtccggtccttccccctggccaccctcctcccaagacgcacctctgggggcacgacgcggccctgggctgcctgtcaaggctaacgtccagactancacngng

SEQ ID NO: 358534 - DNA, 600 bp, Homo sapiens
  misc_feature: GZ8MTXP02H3ADF.9.34.D01.1.454.CMB.2.raw
  modified_base (365)..(365): a, c, t, g, unknown or other
  misc_feature (365)..(365): n is a, c, g, or t
  modified_base (419)..(419): a, c, t, g, unknown or other
  misc_feature (419)..(419): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgtattttcgactccctccgcngtcgactactttgattacgtgggggcccggggaacccgtggtcgccgttttccncctcacgccctccaccgacggcccacgtccggtcccttcccccgtcggccctacccctccctaccaacgacgaccacccgtcggtcgggggaccacgacggccggcccgtcgggcctcggccgtcggtaccgaacggtaccttaaccgttccgaacgtaccgtactaccacgtacggacgg

SEQ ID NO: 358535 - DNA, 565 bp, Homo sapiens
  misc_feature: GZ8MTXP02GX51X.9.34.D01.1.454.CMB.2.raw
  modified_base (302)..(302): a, c, t, g, unknown or other
  misc_feature (302)..(302): n is a, c, g, or t
  modified_base (456)..(456): a, c, t, g, unknown or other
  misc_feature (456)..(456): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccaggggagggactggagtgggtcgcaggcatcgctgggtggcggtcatgacacattctacgcaaactccgtgaggggccncttcatcatctccagagacaattccccagaacatactgtctctgcaacctcaaatacctgagaggcgaggacacggccatttattctgtgcgaaggaggcatagtgggaagtacgtattttcgatcccctcgcagtcgactactttgattacgngggggcccgggaacctggtcgccgtcgtcctcacgccctccaccgaacgggcccacgtcccggtccttcccccgtggcccaccccgttcctaccaacgacgcctacccg

SEQ ID NO: 358536 - DNA, 551 bp, Homo sapiens
  misc_feature: GZ8MTXP02HVLWT.9.34.D01.1.454.CMB.2.raw
  modified_base (231)..(231): a, c, t, g, unknown or other
  misc_feature (231)..(231): n is a, c, g, or t
  modified_base (325)..(325): a, c, t, g, unknown or other
  misc_feature (325)..(325): n is a, c, g, or t
  modified_base (380)..(380): a, c, t, g, unknown or other
  misc_feature (380)..(380): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattcacgcaaactccgtgaggggccnttcatcatctccagagacaattccccagaacatactgtctctgcaactcaataacctgagaggcgaggacacggcatttattctgtgcgaaggnggcatagtggaagtacgtattttcgactccctcgcagtcgactacttgattacgnggggcccgggacctggtcgccgtctctcacgccctcaccgaagggcccagtccggtccttcccccgtggtccacccctcctacccaaagacgccaccgtccgtgggggccacgacgccggcccgtgggctgcctggtaccaggactaacgtcacgtcgtatcactcgacgg

SEQ ID NO: 358537 - DNA, 564 bp, Homo sapiens
  misc_feature: GZ8MTXP02IZ4JD.9.34.D01.1.454.CMB.2.raw
  modified_base (362)..(362): a, c, t, g, unknown or other
  misc_feature (362)..(362): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaatacgattttcgattccctccgcngtcgactactttgattacgtgggggcccgggaaccctggtccgccgtctcctcacgccctcaccgaagggccccatccggtccttcccccgtggccacccctcctacccaacgacgccacccgtcgtcgggggacacgacgccggcccgtggggcctcggcctcggtacaacggactaacttcccagacgtatcactgacgg

SEQ ID NO: 358538 - DNA, 546 bp, Homo sapiens
  misc_feature: GZ8MTXP02IQYPV.9.34.D01.1.454.CMB.2.raw
  modified_base (230)..(230): a, c, t, g, unknown or other
  misc_feature (230)..(230): n is a, c, g, or t
  modified_base (359)..(359): a, c, t, g, unknown or other
  misc_feature (359)..(359): n is a, c, g, or t
  modified_base (448)..(448): a, c, t, g, unknown or other
  misc_feature (448)..(448): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccncttcatcatctccagagacaattcccagaacatactgtctctgcaactcaataacctgagaggcgaggacacggccatttatttctgtgcgaaggaggcatatgggaatacgattttcgatccctcgcngtcgacactttgattacgtgggggcccgggaacctggtccgccgtctcctcagccctccaccaacgggcccagtccggtccttcccccnggccacccctcctcccaagacgccacctcgtgggggccacgacgccggccctggggcctggccctggcaaggctaacgtccagacgtatcactgacgg

SEQ ID NO: 358539 - DNA, 545 bp, Homo sapiens
  misc_feature: GZ8MTXP02F0FK8.9.34.D01.1.454.CMB.2.raw
  modified_base (326)..(326): a, c, t, g, unknown or other
  misc_feature (326)..(326): n is a, c, g, or t
  modified_base (400)..(400): a, c, t, g, unknown or other
  misc_feature (400)..(400): n is a, c, g, or t
  modified_base (439)..(439): a, c, t, g, unknown or other
  misc_feature (439)..(439): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctcggggccccagggcaggagggtcaccatctcgtgcactggaagtagctccaacagtcggggcacgttatgatgtacactggtaccaaacaaccttcaaggaacacgacccccaaagtcatcaatttanagacaacatcgaagccgccctacgacggggtccctagaccgtactcctccggcctccaagtctcgcacatcacnccctccctgcccatccacgtcggctccgaggctaggagntgagctagactatactgaccagtcgtatgacgtcgtacggacctaaaagtactacgttcgtaacgtttacggaacgtacgggaacctaacggtccaaccgttccgg

SEQ ID NO: 358540 - DNA, 573 bp, Homo sapiens
  misc_feature: GZ8MTXP02IXCE1.9.34.D01.1.454.CMB.2.raw
  modified_base (232)..(232): a, c, t, g, unknown or other
  misc_feature (232)..(232): n is a, c, g, or t
  modified_base (329)..(329): a, c, t, g, unknown or other
  misc_feature (329)..(329): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccagaacatactgtctctgcaactcaaataacctgagaggcgaggacacggcctatttattctgtgcgaaggngcatagtggaatacgatttcgatccctcgcagtcgactactttgacttacgtcgggggacccggggaaccctggtccgccgtcgtccctcacgccctccaccgaacgggcccacgtccggtcccttcccccgtcggcccacccctcctacccaaacgcgcctaccgtcgtcgggggcacgacgccggcccgtgggctcgccgtcggtacgaacggactaacgtccagacgtactcacgtgacgg

SEQ ID NO: 358541 - DNA, 460 bp, Homo sapiens
  misc_feature: GZ8MTXP02JKAP0.9.34.D01.1.454.CMB.2.raw
  modified_base (439)..(439): a, c, t, g, unknown or other
  misc_feature (439)..(439): n is a, c, g, or t
  modified_base (454)..(454): a, c, t, g, unknown or other
  misc_feature (454)..(454): n is a, c, g, or t
  modified_base (457)..(460): a, c, t, g, unknown or other
  misc_feature (457)..(460): n is a, c, g, or t
tcagtgatacgtctcacgaccggtgctcgatttagatcgtctgtgttgggtttggggctgttcctggaagttgttggtaccagagggtcaccatctcgtgcactggaagtagctccaacatcggggcacgttatgatgtacactggtaccaacaacttccaggaacagcccccaaacgtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtctcggaactgggaccaaggtcaccgtctggggtcagcccaaggccaaccccactgtccactctgttccccaccctcctcacgacgtatcactgagccgggntgggcaaggcgctanagnnnn

SEQ ID NO: 358542 - DNA, 547 bp, Homo sapiens
  misc_feature: GZ8MTXP02IHHW6.9.34.D01.1.454.CMB.2.raw
  modified_base (232)..(232): a, c, t, g, unknown or other
  misc_feature (232)..(232): n is a, c, g, or t
  modified_base (362)..(362): a, c, t, g, unknown or other
  misc_feature (362)..(362): n is a, c, g, or t
  modified_base (381)..(381): a, c, t, g, unknown or other
  misc_feature (381)..(381): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattccccagaacatactgtctctgcaactcaataacctgagaggcgaggacacggccatttatttctgtgcgaaggaggcatatgggaatacgattttcgatccctcgcngtcgacactttgattacgnggggcccgggaaccctggcgccgtctcctcacgcctccaccaacgggcccatccggtccttccccctcggccacccctcctcccaagacgccacctcgtgggggcacgacgcggccctgggctcgcctggtacaaggactaacgttccagacgtatcactcgacgg

SEQ ID NO: 358543 - DNA, 560 bp, Homo sapiens
  misc_feature: GZ8MTXP02IYJBJ.9.34.D01.1.454.CMB.2.raw
  modified_base (302)..(302): a, c, t, g, unknown or other
  misc_feature (302)..(302): n is a, c, g, or t
  modified_base (458)..(458): a, c, t, g, unknown or other
  misc_feature (458)..(458): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccaggggagggactgggagtgggtcgcaggcatcgctggtggcggtcatgacacattctacgcaaactccgtgaggggccncttcatcatctccagagacaattccccagaacatactgtctctgcaactcaataacctgagaggcgaggacacggccattttattctgtgcgaaggaggcagtagtggggaaagtacgtattttcgatccctcgcagtcgactactttgattacgngggggccgggaacctggtcgccgtctcctcacgcctccaccgaacgggcccacgtccggtccttcccccgtggcccacccctcctccaacgacgacctaccg

SEQ ID NO: 358544 - DNA, 562 bp, Homo sapiens
  misc_feature: GZ8MTXP02G7XHI.9.34.D01.1.454.CMB.2.raw
  modified_base (231)..(231): a, c, t, g, unknown or other
  misc_feature (231)..(231): n is a, c, g, or t
  modified_base (360)..(360): a, c, t, g, unknown or other
  misc_feature (360)..(360): n is a, c, g, or t
  modified_base (380)..(380): a, c, t, g, unknown or other
  misc_feature (380)..(380): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggccatttattctgtgcgaaggaggcatatgggaagtacgattttcgatccctcgcngtcgactactttgattacgnggggcccgggaaccctggtcgccgtctcctcagcctccaccaacgggcccagtccggtccttcccccgtcggccaccctcctaccaacgacgccacctcgtcgggggccacgacgccggcccgtgggctcgccgtcggtaccgaacggacctaacgttccacgtacgtatccacgtcgacgg

SEQ ID NO: 358545 - DNA, 569 bp, Homo sapiens
  misc_feature: GZ8MTXP02JG1G3.9.34.D01.1.454.CMB.2.raw
  modified_base (324)..(324): a, c, t, g, unknown or other
  misc_feature (324)..(324): n is a, c, g, or t
  modified_base (470)..(470): a, c, t, g, unknown or other
  misc_feature (470)..(470): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcacgtggaagtagctaccaacagtcggggcacgttatgatgtacacgtggtaaccaacaacttccaggaacacgaccccaaagtcatcatttangacaacatacgaacgccggccctcgacggggtccctagccgattccgccggcctccaagtctggaccacatcacgccctcccgtagcccatccaacgtcgggacctcccgaggctaggacggatcggagcgtagtacttagttacngcctagttacgtagttacgactacggtacggacttaaacgtaacacgttcgtaacgttacggaacgttcggggaacctaacggttccgaaccgttccgg

SEQ ID NO: 358546 - DNA, 565 bp, Homo sapiens
  misc_feature: GZ8MTXP02F4U44.9.34.D01.1.454.CMB.2.raw
  modified_base (302)..(302): a, c, t, g, unknown or other
  misc_feature (302)..(302): n is a, c, g, or t
  modified_base (535)..(535): a, c, t, g, unknown or other
  misc_feature (535)..(535): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccagaacatactgtctctgcaacctcaataacctgagaggcgaggacacggcctatttattctgtgacgaaggagcatagtgggaagtacgtatttcgactccctcgcagtcgactactttgagttacgtcggggaccgggacctggtccgccgtctccgtcgacgccctaccgaccgtaacgggccctacgtccggtccttcccccgnggcccaccctcctaccgaacgcgctacccg

SEQ ID NO: 358547 - DNA, 598 bp, Homo sapiens
  misc_feature: GZ8MTXP02GWJDK.9.34.D01.1.454.CMB.2.raw
  modified_base (362)..(362): a, c, t, g, unknown or other
  misc_feature (362)..(362): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcngtcgactactttgattacgtcggggcccggggaaccctggtccgccgtctcctcacgccctccaccgaacgggccccacgtccggttcccttcccccgtcggccctacccctccctacccaacgacgaccaccctccgtcgggggccacgacgccggccccgtggggcctcggcccgttcgggtaccaacgggtacctaaccgttccgaacgtaccgtactcgaaccgtggacggg

SEQ ID NO: 358548 - DNA, 535 bp, Homo sapiens
  misc_feature: GZ8MTXP02H9EG4.9.34.D01.1.454.CMB.2.raw
  modified_base (230)..(230): a, c, t, g, unknown or other
  misc_feature (230)..(230): n is a, c, g, or t
  modified_base (534)..(534): a, c, t, g, unknown or other
  misc_feature (534)..(534): n is a, c, g, or t
tcagtgatacgtctcacgaccggtgctcgatttagatcgtctgtgttgggtttggggaggcttggtccagcctgggcagtccctgcgactctcctgtgtggcctctggattcacctttgagacctatgccttgacctgggtccgccaggctccaggggagggactggagtgggtcgcaggcatcgctgggtggcggtcatgacacattcacgcaaactccgtgaggggcncttcatcatctcagagacaattcccagaacatactgtctctgcaactcaataacctgagaggcgaggacacggccatttattctgtgcgaaggaggcatatgggaagtacgatttcgatccctcgcacgtcgactactttgattacgtgggccggggtaaccctggtcgccgtcgtccctcacgcctccaccacggcccagtccggtccttccccctcgccaccctcctccaagacgcacctcgtggggcacgacgcggccctggctgcctcggtcaacggaactactccagacgtactcacgng

SEQ ID NO: 358549 - DNA, 587 bp, Homo sapiens
  misc_feature: GZ8MTXP02IVJW1.9.34.D01.1.454.CMB.2.raw
  modified_base (466)..(466): a, c, t, g, unknown or other
  misc_feature (466)..(466): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccaagaacatactgtctctgcaactcaaataacctgagaggcgaggacacggccatttatttctgtgcgaaggaggcatagtgggaagtacgtattttcgattccctccgcagtcgactactttgattacgtgggggcccgggaacccgtggtccgccgtctcctcacgtccctccaccgaacgggcccagtccggtccctttcccccgnggccctaccccctcctacccaacgacgccaccgtcggtcgggggcacgacggcccggcccgtggggcttcgccgtcggacaacggacctaacgttcccagtaccgtatacacgtagaccgg

SEQ ID NO: 358550 - DNA, 535 bp, Homo sapiens
  misc_feature: GZ8MTXP02I4NJF.9.34.D01.1.454.CMB.2.raw
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctcgcagtcgacactttgattactggggcccgggaaccctggtcgccgtctcctcagcctcaccaagggcccatccggtccttccccctggccacccctcctccaacgacgcacctctcgggggcacgagcggccctgggctgcctggtcaaggactaacgtccagacgtatcactgacgg

SEQ ID NO: 358551 - DNA, 537 bp, Homo sapiens
  misc_feature: GZ8MTXP02H1DO4.9.34.D01.1.454.CMB.2.raw
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
  modified_base (362)..(362): a, c, t, g, unknown or other
  misc_feature (362)..(362): n is a, c, g, or t
  modified_base (445)..(445): a, c, t, g, unknown or other
  misc_feature (445)..(445): n is a, c, g, or t
  modified_base (473)..(473): a, c, t, g, unknown or other
  misc_feature (473)..(473): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattcngtgcgaaggnggcagtatgggaagtacgattttcgattccctcgcngtcgactactttgattacgtggggcccgggaacctggcgcgtctcctcagcctcaccaacgggcccagtccggtccttccccnggccaccctcctccaagacgcacctcgnggggccacgacgcggcccgtgggctcgcctgcaacggactaacgtccagtacgatcactgacgg

SEQ ID NO: 358552 - DNA, 535 bp, Homo sapiens
  misc_feature: GZ8MTXP02II9OI.9.34.D01.1.454.CMB.2.raw
  modified_base (364)..(364): a, c, t, g, unknown or other
  misc_feature (364)..(364): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaaataacctgagaggcgaggacacggccatttatttctgtgcgaaggaggcatatgggaagtacgattttcgatccctccgcngtcgacactttgattacgtgggggcccggggaaccctggtccgccgtctcctcagcctcaccaaggcccatcggtcttcccctggcaccctctccaagacgcactctgggggcacagcggccctgggctgccctggtaccaggactaacgttcccagcgtatactgagcgg

SEQ ID NO: 358553 - DNA, 618 bp, Homo sapiens
  misc_feature: GZ8MTXP02GMVH5.9.34.D01.1.454.CMB.2.raw
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
  modified_base (328)..(328): a, c, t, g, unknown or other
  misc_feature (328)..(328): n is a, c, g, or t
  modified_base (485)..(485): a, c, t, g, unknown or other
  misc_feature (485)..(485): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctcggggccccagggcagagggtcaccatctcgtgcactggaagtgctccaanatcggagctacgttangatgtacacgtacgtaaccaactactaccgaacgaacaccgaaccccaagtcatactatttanacgaaacacagtagaacgccgtccctacggtaccggggttccctcggaaccgtacttcccggccgtacctaccgtaacgttccgacgaccaactactaccgacgtccccttccggcgacctacgtccgacgtcggcctacggagtctagggactagnggacgtctagtaacttacgttacgcgacccgtaggttacctagtacgaacgtagggtaccgtaaacgtaaaacgacttcgtaacgttaccgtaaacgggtaccgtacggaaccgtaacgtcccgttaaccggg

SEQ ID NO: 358554 - DNA, 613 bp, Homo sapiens
  misc_feature: GZ8MTXP02H1LB3.9.34.D01.1.454.CMB.2.raw
  modified_base (233)..(233): a, c, t, g, unknown or other
  misc_feature (233)..(233): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (387)..(387): a, c, t, g, unknown or other
  misc_feature (387)..(387): n is a, c, g, or t
  modified_base (416)..(416): a, c, t, g, unknown or other
  misc_feature (416)..(416): n is a, c, g, or t
  modified_base (490)..(490): a, c, t, g, unknown or other
  misc_feature (490)..(490): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattccccaagaacatactgtctctgcaactcaaataacctgagaggcgaggacacggctatttatttctgtgacgaaggaggcatagtggaagtacgtattttcgactcccncgcngtcactacttgattacgngggggacccggaccctggccgcgtctccncacgccctccaaccgaacgggcccacgttccggttcccttcccccgtcggccctaccccctctacccaacgacncctacccgtcggtcgggggaccacgacggccggtcccgtggggcctacggcccgttcgggaccaaacggtacccttaaccgttacccgaaacggtaccgttaaccaccgtacggtacggacgg

SEQ ID NO: 358555 - DNA, 572 bp, Homo sapiens
  misc_feature: GZ8MTXP02JXMSX.9.34.D01.1.454.CMB.2.raw
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaacctcaatacctgagaggcgagacacggcctatttatttctgtgcgaaggaggacagtagtgggtaagtacgtatttcgactcccgtccgcagtcgactacgtttgatttacgcggggacccgggtaccgtgggtccgccgttctcctcacgccctccaccgaacgggcccacgtccggtccttcccccgtggccctacccctccctaccgaacgacgaccacccg

SEQ ID NO: 358556 - DNA, 560 bp, Homo sapiens
  misc_feature: GZ8MTXP02INTUS.9.34.D01.1.454.CMB.2.raw
  modified_base (328)..(328): a, c, t, g, unknown or other
  misc_feature (328)..(328): n is a, c, g, or t
  modified_base (359)..(359): a, c, t, g, unknown or other
  misc_feature (359)..(359): n is a, c, g, or t
  modified_base (450)..(450): a, c, t, g, unknown or other
  misc_feature (450)..(450): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaaataacctgagaggcgaggacacggccatttattctgtgcgaaggngcatatgggaatacgatttcgatccctcgcngtcgactactttgattacgtgggggacccgggacctggccgccgtctcctcacgccctccaccgaacgggcccagtccggtccttcccccncggcccacccctcctacccaacgacgccacctcgtcgggggcacgacggccggcccgtggggctcgccgtcggtacaacggactaacttccagtacgtatcacgtgacgg

SEQ ID NO: 358557 - DNA, 774 bp, Homo sapiens
  misc_feature: GZ8MTXP02H97CM.9.34.D01.1.454.CMB.2.raw
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacacttcaggaacacgccccaaagtcatcatttatgaacaacatcgaacgccggacccctcggacggggtccccctaggacccgtactttccgtacccgggtccttacccgaaacggttccgttacgggaccctaaccaacttcccgaaccggtcccccttacccccgttaccggggccccctaaacgtttccccgaaacccggttccgggggtacccttccccggaaacggggtccccgttaggggaaaccgggtaacgttggggtaaacgggccgttacgggtaaacccttttacgtttaaacccgtttcggacccccgttaaagggtttcccggttaaagttacggtaaaccgtaacgggttaccggggtaaaccctttaaaacggtaaacccgttacgttacccggtttaaccgttttaaccggggaaaaccgtttcgggggaaaaccccgttaaaacggggttcccgtaaaccccggggtttccccggg

SEQ ID NO: 358558 - DNA, 618 bp, Homo sapiens
  misc_feature: GZ8MTXP02IN3XO.9.34.D01.1.454.CMB.2.raw
  modified_base (233)..(233): a, c, t, g, unknown or other
  misc_feature (233)..(233): n is a, c, g, or t
  modified_base (333)..(333): a, c, t, g, unknown or other
  misc_feature (333)..(333): n is a, c, g, or t
  modified_base (398)..(398): a, c, t, g, unknown or other
  misc_feature (398)..(398): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactgggagtgggtcgcaggcatcgctggtggcggtcatgacacattctacgcaaactccgtgaggggccncttcatcatctccagagacaattcccaagaacatactgtctctgcaactcaaataacctgagaggcgaggacacggccatttatttctgtgcggaaaggnggcatagtggggaaagtacgtattttcgactcccctccgcaggtccactactttgactttacggngggggcccggggaacccgtggtccgccgtcctccctcacgcccaccaccgaacggcccactccggtccctcccccgtcggccaccccgtccctaccaacgacgccaccgtcggtcgggggaccacgacggccgggcccgtcgggtccgtcgcccgttcgggtaccgaaacgggtacctaaccgttacccgaacgaccggttactaccacgtacggacggg

SEQ ID NO: 358559 - DNA, 558 bp, Homo sapiens
  misc_feature: GZ8MTXP02G7P3Z.9.34.D01.1.454.CMB.2.raw
  modified_base (231)..(231): a, c, t, g, unknown or other
  misc_feature (231)..(231): n is a, c, g, or t
  modified_base (317)..(317): a, c, t, g, unknown or other
  misc_feature (317)..(317): n is a, c, g, or t
  modified_base (379)..(379): a, c, t, g, unknown or other
  misc_feature (379)..(379): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggaatgggtcgcaggcatcgctggtggcggtcatgacacattctacgcaaactccgtgaggggccncttcatcatctccagagacaattcccagaacatactgtctctgcaactcaataacctgagaggcgaggacacggccatttatttcngtgcgaaggagcatatgggaatacgattttcgatccctcgcagtcgacactttgatttacgnggggccggggaaccctggtccgccgtctcctcacgccctccaccaacgggcccatccggtccttccccctcggccacccctcctcccaaagcgccacctcgtcgggggcacgacgccggcccgtgggctgcctcggtacaaggactaacgttccgaacgtaccgtatccgactcgacgg

SEQ ID NO: 358560 - DNA, 676 bp, Homo sapiens
  misc_feature: GZ8MTXP02JNULD.9.34.D01.1.454.CMB.2.raw
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctcaganacaattcccaagaacatactgtctctgcaactcaaataacctgagaggcgaggacacggcctattttatttcgngtgaggaggnganagtaggaggtaacgtagttacttcgacctcccgtcgacgtcgtacgaacttacgttagtaacgttacgggtccgggggacccggtacccgtcgggtcccgtcccgttcctcctaccgaccgtcccctaccgaaacccgggaccgggtaccctaccggttcccggttcccccttacccggtccggacccctaccccgtacccgtaaccgaacgccgacccgtccgttacggggccggggaaccacgggccggcccggtccggcggtccgtccgtccggtacgtaaccggtaacgtacctttaaccgaccgtaacggtactaccgacgtaacgcgggaccggg

SEQ ID NO: 358561 - DNA, 546 bp, Homo sapiens
  misc_feature: GZ8MTXP02FT8KI.9.34.D01.1.454.CMB.2.raw
  modified_base (360)..(360): a, c, t, g, unknown or other
  misc_feature (360)..(360): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgatttcgatccctccgcngtcgacactttgattacgtggggccggggaaccctggtcgccgtctcctcacgccctccaccgaacgggcccatccggtccttcccccgtggccacccctcctaccaacgagccacctcgtgggggccacgacgccggccctggacctgcctggtacaggactaactccagacgtatcactgacgg

SEQ ID NO: 358562 - DNA, 613 bp, Homo sapiens
  misc_feature: GZ8MTXP02F2WQW.9.34.D01.1.454.CMB.2.raw
  modified_base (321)..(321): a, c, t, g, unknown or other
  misc_feature (321)..(321): n is a, c, g, or t
  modified_base (556)..(556): a, c, t, g, unknown or other
  misc_feature (556)..(556): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctcggggccccagggcaggagggtcaccatctcgtgcacgtggaagtagctccaacagtcggggcacgttatgatgtacactggtaccaacactccaggaacacgaccccaaagtcatcatttangacaacatacgaacgccgaccctcgacggggtcccctagacccgtattccgtccggacctacccgaagtcctggaccaacactccaacgtcccctcccgtacggaccctaatccgacgtcgggccttaccggaggtccgtaggaaggacgtagggacggtacctaggaacttagttacgtcgaccgtaggttccgtaaagtcgaacgtacggtacggtaaccttaaagtaaaccncgtttaccggtaacgttaacggaacggtaccggaacgtaacggtcccgtacgtccgg

SEQ ID NO: 358563 - DNA, 613 bp, Homo sapiens
  misc_feature: GZ8MTXP02IL893.9.34.D01.1.454.CMB.2.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatagtggggaagtacgattttcgatccctccgcagtcgacactttgattacgtggggccgggaaccctggtccgccgtctcctcacgccctccaccgaacgggccccagtccggtccttcccccgtcggcctaccccgtcctacccaacgacgccacccgtcgtgggggccacgacggccggccccgttgggggccttcggccccgttagggttaccgaaacggggtacccttaacgtttccccgaaaggtaccgttaacgtcccaaccgttggaaccgggg

SEQ ID NO: 358564 - DNA, 558 bp, Homo sapiens
  misc_feature: GZ8MTXP02GMTKW.9.34.D01.1.454.CMB.2.raw
  modified_base (362)..(362): a, c, t, g, unknown or other
  misc_feature (362)..(362): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcngtcgacactttgattacgtggggcccggggaaccctggtcgccgtctcctcacgcctccaccaacgggcccagtccggtccttccccctggccacccctcctccaaacgcgccacctcgtcgggggccacgacgccggcccctggggcctgccctcggtaccaaggactaacgttcccagaccgtatcactgacgg

SEQ ID NO: 358565 - DNA, 553 bp, Homo sapiens
  misc_feature: GZ8MTXP02HXZZZ.9.34.D01.1.454.CMB.2.raw
  modified_base (526)..(526): a, c, t, g, unknown or other
  misc_feature (526)..(526): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgagggccgcttcatcatctccagagacaattcccagaacatactgtctctgcaactcaaactacctgagaggcgaggacacggcctatttattctgtgcgaaaggaggcatagtagggaagtacgtatttcgactccctcgctagtcgactactttgattacgtgggggccgggaaccgtggtcgccgtctcctcacgcctccacgaacgggcccagtccggtccttccccgngccaccctcctaccaacgcgaccaccg

SEQ ID NO: 358566 - DNA, 573 bp, Homo sapiens
  misc_feature: GZ8MTXP02INDUR.9.34.D01.1.454.CMB.2.raw
  modified_base (362)..(362): a, c, t, g, unknown or other
  misc_feature (362)..(362): n is a, c, g, or t
  modified_base (381)..(381): a, c, t, g, unknown or other
  misc_feature (381)..(381): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcagacatcgctggtggcggtcatgacacattctacgcaaactccgtgaggggccgcttcatcatctccagagacaattccccagaacatactgtctctgcaactcaataacctgagaggcgaggacacggccatttatttctgtgcgaaggaggcatatggaagtacgattttcgatccctcgcngtcgacactttgattacgngggggcccgggaacccgtggtccgccgtctcctcacgccctccaccaacgggccccagtccggtcctttcccccgtcggcccacccctcctacccaacgacgccaccgtcgtcgggggccacgacggccggcccgtgggcctcgcccgtcggtacaaggacctaacttccacgaccgtatccacgtcgacgg

SEQ ID NO: 358567 - DNA, 591 bp, Homo sapiens
  misc_feature: GZ8MTXP02HGFMY.9.34.D01.1.454.CMB.2.raw
  modified_base (457)..(457): a, c, t, g, unknown or other
  misc_feature (457)..(457): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattacgtgggggcccggggaaccctgggtccgccgtctccctcacgtcctccaccaacgggcccattccgggtcctttcccccnggtccacccctcctacccaacgacgcacctcgtcgggggcacgacgccggccccgttggggccttcggcccgttgggtaccaacgggtaccttaaccgttcccgaacgtacccgttatccaaccgttggaacgg

SEQ ID NO: 358568 - DNA, 494 bp, Homo sapiens
  misc_feature: GZ8MTXP02GYDHJ.9.34.D01.1.454.CMB.2.raw
  modified_base (485)..(494): a, c, t, g, unknown or other
  misc_feature (485)..(494): n is a, c, g, or t
tcagtgatacgtctcacgaccggtgctcgatttagatcgtctgtgttgggtttgggattcacctttgagacctatgccttgacctgggtccgccaggctccaggggagggactggagtgggtcgcaggcatcgctggtggcggtcatgacacattctacacaaactccgtgaggggccgcttcatcatctccagagacaattcccagaacatactgtctctgcaactcaataacctgagaggcgaggacacggccatttattctgtgcgaaggaggcatatgggaatacgattttcgatccctccgcagtcgacactttgattactggggccgggaacctggtcgccccgtctcctcagcctccaccagggcccatcgtctcccctgcaccctcctccaagagcacctctggggcacagcgccctgggctgcctggcaaggctactccagacgtatcactgagcggctgggcaaggcgacatagnnnnnnnnnn

SEQ ID NO: 358569 - DNA, 551 bp, Homo sapiens
  misc_feature: GZ8MTXP02GFK1L.9.34.D01.1.454.CMB.2.raw
  modified_base (361)..(361): a, c, t, g, unknown or other
  misc_feature (361)..(361): n is a, c, g, or t
  modified_base (542)..(542): a, c, t, g, unknown or other
  misc_feature (542)..(542): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggagcatatgggaagtacgatttcgatccctccgcngtcgactactttgattacgtgggggcccgggaaccctggtccgccgtctcctcacgccctccaccgacgggcccagtccggtccttccccctggccacccctcctccaacgcgcacctcgtggggcacgacggccgcccgtgggctcgccgtggtcaaggtactaacgttccgagacgtancactgacgg

SEQ ID NO: 358570 - DNA, 620 bp, Homo sapiens
  misc_feature: GZ8MTXP02F7AQT.9.34.D01.1.454.CMB.2.raw
  modified_base (231)..(231): a, c, t, g, unknown or other
  misc_feature (231)..(231): n is a, c, g, or t
  modified_base (360)..(360): a, c, t, g, unknown or other
  misc_feature (360)..(360): n is a, c, g, or t
  modified_base (380)..(380): a, c, t, g, unknown or other
  misc_feature (380)..(380): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggccatttattctgtgcgaaggaggcatatgggaagtacgtatttcgatccctcgcngtcgactactttgattacgngggggcccgggaacccgtggtcgcccgtcgtcctcacgcctccaccgaacgggcccagtccggtccttcccccgtggcccacccctcctacccaaacgacgccaacccgtccgtcgggggaccaccgacggccgggcccccgttggggcccgttcggcccgtcggggttacccaaacggggtacccttaaccgtttacccgaacggtaccggttaactaccgaaccgttggaaaccgggg

SEQ ID NO: 358571 - DNA, 513 bp, Homo sapiens
  misc_feature: GZ8MTXP02FUQNS.9.34.D01.1.454.CMB.2.raw
  modified_base (362)..(362): a, c, t, g, unknown or other
  misc_feature (362)..(362): n is a, c, g, or t
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
  modified_base (455)..(455): a, c, t, g, unknown or other
  misc_feature (455)..(455): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcngtcgactactttgattacgtgggggccgggaaccctggtccgcgtctctcagcctcacaggccatcgtctcccngcacctcncagngcactcngggcacgagcgcctggctgccgtcgtcaaggactaacgtccagacgtatcactgacgg

SEQ ID NO: 358572 - DNA, 551 bp, Homo sapiens
  misc_feature: GZ8MTXP02IZRM0.9.34.D01.1.454.CMB.2.raw
  modified_base (232)..(232): a, c, t, g, unknown or other
  misc_feature (232)..(232): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattccccagaacatactgtctctgcaactcaaataacctgagaggcgaggacacggccatttatttctgtgcgaaggaggcatatgggaagtacgattttcgatccctccgcagtcgacactttgattacgtgggggccgggaaccctggtcgccgtctcctcagccctcaccaagggcccatccggtccttccccctggccacccctcctacccaaacgcgacctacctcgtgggggacacgacgccggcctggctcgcctcggtacaaggactaacttccagacgtatcactgacgg

SEQ ID NO: 358573 - DNA, 581 bp, Homo sapiens
  misc_feature: GZ8MTXP02JWM0P.9.34.D01.1.454.CMB.2.raw
  modified_base (363)..(363): a, c, t, g, unknown or other
  misc_feature (363)..(363): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatagtgggaagtacgattttcgatccctcgcngtcgactactttgattacgtgggggcccggggaaccctggtccgccgtctcctcacgccctccaccgaacgggcccacgtccggtccttcccccgtcggcccacccctccctaccaacgacgccaccgtcgtcgggggcacgacggccggcccgtgggcctcggccgtcggtcgaacggtacctaaccgttccgacgtaccgtatccgactcgacggg

SEQ ID NO: 358574 - DNA, 565 bp, Homo sapiens
  misc_feature: GZ8MTXP02FURLA.9.34.D01.1.454.CMB.2.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgactactttgattacgtgggggcccggggaaccctggtccgccgtctcctcacgcctccaccgaacgggcccatccggtccttcccccgtggcccacccctccctaccaacgacgccaccgttcgcgggggacacgacgccggcccgtggggcctcgccctggtaccaggactaacgttccagacgtactcactgacgg

SEQ ID NO: 358575 - DNA, 583 bp, Homo sapiens
  misc_feature: GZ8MTXP02GW4B8.9.34.D01.1.454.CMB.2.raw
  modified_base (392)..(392): a, c, t, g, unknown or other
  misc_feature (392)..(392): n is a, c, g, or t
  modified_base (571)..(571): a, c, t, g, unknown or other
  misc_feature (571)..(571): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgagggccgcttcatcatctccagagacaattcccagaacatactgtctctgcaactcaataacctgagaggcgaggacacggcctatttatttctgtgacggaaggaggcagtagtggggaacgtacgtattttcgattcccctcgcagtcgactactttgattacgngggggcccgggaaccctggtccgccgtctcctcacgccctccaccgaacgggcccagttccggtccttcccccgtcggcccacccctccgtccaacgacgccacctcggtcgggggccacgacgccggcccgtggggcctcgccgtcggtacaaggtacctaacgtcccagacgttacncgacgcggacgg

SEQ ID NO: 358576 - DNA, 586 bp, Homo sapiens
  misc_feature: GZ8MTXP02JU5NA.9.34.D01.1.454.CMB.2.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctcgggcccagtctgttctgacgcagccgccctcagtgtctcggggccccagggcaggagggtcaccatctcgtgcactggaagtagctaccaacagtcggggcacgttatgatgtacactgtaccaacaacttccaggaacacgacccccaaagtcatctattatagacaacatacgaacgccgccctcgacggggtccctgaccgtacttccgtcccggcctaccgaagtcctacgggaccactactcccgacgcccctcccgtcgcccactccacgtcgggctcccgaggtcctggacgatggaggctagacttatacgtcgaccagttcgtagttacgacgacggtcggaacccttaaaggtacagttccgtaaccgtttacgggaacgttccggggaacctaacgggttccaccggtttccgg

SEQ ID NO: 358577 - DNA, 556 bp, Homo sapiens
  misc_feature: GZ8MTXP02I45FJ.9.34.D01.1.454.CMB.2.raw
  modified_base (363)..(363): a, c, t, g, unknown or other
  misc_feature (363)..(363): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccaagaacatactgtctctgcaactcaaataacctgagaggcgaggacacggccatttattctgtgcgaaggaggcatagtggaagtacgattttcgatccctcgcngtcgactactttgattacgtcggggaccgggaaccctggtcgccgtctcctcacgccctccaccaacgggcccagtccgtccttcccctggcccaccctcctaccaacgacgccacctcgtaggggcacgacggtccgcccgtgggcctcgccctggtaccaaggactaacgtcacgacgtactcactgacgg

SEQ ID NO: 358578 - DNA, 590 bp, Homo sapiens
  misc_feature: GZ8MTXP02GW780.9.34.D01.1.454.CMB.2.raw
  modified_base (328)..(328): a, c, t, g, unknown or other
  misc_feature (328)..(328): n is a, c, g, or t
  modified_base (361)..(361): a, c, t, g, unknown or other
  misc_feature (361)..(361): n is a, c, g, or t
  modified_base (462)..(462): a, c, t, g, unknown or other
  misc_feature (462)..(462): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggnggcatatggaagtacgattttcgatccctcgcngtcgactactttgattacgtgggggcccgggaaccctggtccgcccgtctccctcacgccctccaccgaacgggcccacgttccggtccctttccccccgnggtcccacccccttcctacccaaacgacgccacccgttcgcgggggccacgacgcccggcccgtggggcctcgcccgtcggtaccaacggtacctaacgttcccaagtaccgtacacgtgacggcggg

SEQ ID NO: 358579 - DNA, 598 bp, Homo sapiens
  misc_feature: GZ8MTXP02HFQJU.9.34.D01.1.454.CMB.2.raw
  modified_base (362)..(362): a, c, t, g, unknown or other
  misc_feature (362)..(362): n is a, c, g, or t
  modified_base (382)..(382): a, c, t, g, unknown or other
  misc_feature (382)..(382): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggcatttattctgtgcgaaggaggcatagtgggaagtacgtattttcgatccctcgcngtcgactactttgattacgngggggcccgggaaccctggtcgccgtctcctcacgccctccaccgaacgggcccacgtccgtccttcccccgtcggcccacccctcctacccaacgacgccacccgtcggtcgggggcacgacggtcccggcccgtcggggcctcggccgtcgggtaccgaacgggtaccctaacgtttacccgaacgtaccgtactaccgtaccgtaggacgggg

SEQ ID NO: 358580 - DNA, 456 bp, Homo sapiens
  misc_feature: GZ8MTXP02IHF13.9.34.D01.1.454.CMB.2.raw
  modified_base (367)..(367): a, c, t, g, unknown or other
  misc_feature (367)..(367): n is a, c, g, or t
  modified_base (451)..(456): a, c, t, g, unknown or other
  misc_feature (451)..(456): n is a, c, g, or t
tcagtgatacgtctcacgaccggtgctcgatttagatcgtctgtgttgggtttgggggctgttcctggaagttgttggtaccagtgtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggcccatcactgggctccaggctgaggatgaggctgactatactgccagtcgtatgacagtggcctaaagtaacatcgtcttccggaactgggaccaaggtcaccgtcngggtcagcccaagccaacccactcgcactctcgttccccaccctcctcagactactcactgacgcggctggacaggcgcatagnnnnnn

SEQ ID NO: 358581 - DNA, 621 bp, Homo sapiens
  misc_feature: GZ8MTXP02J0ORZ.9.34.D01.1.454.CMB.2.raw
  modified_base (232)..(232): a, c, t, g, unknown or other
  misc_feature (232)..(232): n is a, c, g, or t
  modified_base (361)..(361): a, c, t, g, unknown or other
  misc_feature (361)..(361): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgagacacggcatttattctgtgcgaaggagcatagtgggaagtacgtatttcgactccctccgcngtcgactacgtttgacttacgtcgggggacccggggaacccgtggtccgcccgtctccgtcacgccctaccaccgacgggcccacgtccggttcccttcccccgtcggccctacccctccctacccgaacgaccgtccaacccgtccggtcgggggaccacgacggcccggtcccggtggggcccgttcggcccgttcgggtaccgaaacgggtaccctaaccgttcccgaacgtacggttactcctaacgtcggacggg

SEQ ID NO: 358582 - DNA, 616 bp, Homo sapiens
  misc_feature: GZ8MTXP02JDT51.9.34.D01.1.454.CMB.2.raw
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (368)..(368): a, c, t, g, unknown or other
  misc_feature (368)..(368): n is a, c, g, or t
  modified_base (389)..(389): a, c, t, g, unknown or other
  misc_feature (389)..(389): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctcaganacaattcccagaacatactgtctctgcaactcaaataacctgagaggcgagacacggcctatttattctgtagcgaaggaggcagtagtggggaaatacgtattttcgacttccctcgcngtcgaactactttgattacgngggggacccgggaacccgtggtcgccgtctcctcacgccctccaaccgacgggcccacgtccgggtcccttcccccgtcggccctacccctccctacccgaaacgacgcctacccgtcggtacgggggccaacgacgcccgggcccgtggggcctcggcccgtcggtaccgaaacggtaccttaaccgttacccgaacggtaccgtacgtaccacgtacggaccggg

SEQ ID NO: 358583 - DNA, 496 bp, Homo sapiens
  misc_feature: GZ8MTXP02JVHGY.9.34.D01.1.454.CMB.2.raw
  modified_base (316)..(316): a, c, t, g, unknown or other
  misc_feature (316)..(316): n is a, c, g, or t
  modified_base (429)..(429): a, c, t, g, unknown or other
  misc_feature (429)..(429): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacacttccaggaacagcccccaaagtcatcatttangacaacatgaagcgcctcacggggtccctgccgattctccggctccaagtctggcacatcagccctccctgccatcacgtggctccgaggctgagatggagctgactattacngaccagtctatgacagtgacctaagtacagtcgtcgttacggaacgtcgggaccaggtccaccgtcg

SEQ ID NO: 358584 - DNA, 571 bp, Homo sapiens
  misc_feature: GZ8MTXP02GLVBE.9.34.D01.1.454.CMB.2.raw
  modified_base (361)..(362): a, c, t, g, unknown or other
  misc_feature (361)..(362): n is a, c, g, or t
  modified_base (382)..(382): a, c, t, g, unknown or other
  misc_feature (382)..(382): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggagcatagtgggaagtacgattttcgatccctcgnngtcgactactttgattacgngggggacccgggtaaccctggtccgccgtctccctcacgcctccaaccgaacgggcccatccggtccttccccgtggccacccctccaccaaacgacgccaccgtcgcgggggacacgacggccggcccgtgggcctcggccctggtaccaaggtctaaccgttccaagtacgtatccacgtgaacggg

SEQ ID NO: 358585 - DNA, 581 bp, Homo sapiens
  misc_feature: GZ8MTXP02GA8AC.9.34.D01.1.454.CMB.2.raw
  modified_base (329)..(329): a, c, t, g, unknown or other
  misc_feature (329)..(329): n is a, c, g, or t
  modified_base (361)..(362): a, c, t, g, unknown or other
  misc_feature (361)..(362): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggcctatttatttctgtgcgaaggngcatatgggaagtacgatttcgatccctccgnngtcgacactttgattacgtgggggcccggggaaccctggtccgccgtctcctcacgccctccaccaacgggcccatccggtccttccccctcggccacccctcctaccaaacgacgccaaccctcgtcgggggaccacgacggccggccccgtggggcctcgcccgtcgggtaccaagggacctaaccttccaacggtacgtactccaacgtgaacggg

SEQ ID NO: 358586 - DNA, 553 bp, Homo sapiens
  misc_feature: GZ8MTXP02H4TL8.9.34.D01.1.454.CMB.2.raw
  modified_base (537)..(553): a, c, t, g, unknown or other
  misc_feature (537)..(553): n is a, c, g, or t
tcagtgatacgtctcacgaccggtgctcgatttagatcgtctgtgttgggtttggggctgttcctggaagttgttggtaccagtgtcaccatctcgtgcactggaagtagctccaacatcggggcacgttatgatgtacactggtaccaacaacttccaggaacagccccaaagtcatcatttatgacaacatgaagcggccctcaggggtccctgaccgattctccggctcaagtctggcacatcagccctccctggccatcactgggctccgaggctggaggatgaggctgacttattactgccagtcgtatgacagtcggacctaaagtaactagtccgtcgttaccggaacgtgggaacccaaggtccacccggttccgtggggtaccacgaccccgtaaacgggacccccaaacccccgacttcgtacccaccttccgttcccgttccccccaaccccttcccttacaacggtaccttaactccgacgtcggacgtccgggggctacgggaccgaacgggccgacgtagagnnnnnnnnnnnnnnnnn

SEQ ID NO: 358587 - DNA, 529 bp, Homo sapiens
  misc_feature: GZ8MTXP02F3BF7.9.34.D01.1.454.CMB.2.raw
  modified_base (320)..(320): a, c, t, g, unknown or other
  misc_feature (320)..(320): n is a, c, g, or t
  modified_base (354)..(354): a, c, t, g, unknown or other
  misc_feature (354)..(354): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcacgtggaagtagctccaacatcggggcacgttatgatgtacactggtaccaacaactccaggaacacgacccccaaagtcatcatttangacaacatcgaacgcgaccctcgacggggtcccngccgattccgtccggctccaagtctggacacatccacgccctcccgtggcccatcactcgggctccgaggctggagatgagctagactattacgtgcctagtcgtatcgacaggtcggacctaaagtacatcgtaacgttacggaactcgggacctaacggtccaccggtacccg

SEQ ID NO: 358588 - DNA, 582 bp, Homo sapiens
  misc_feature: GZ8MTXP02GJLG6.9.34.D01.1.454.CMB.2.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacacgacccccaaagtcatcatttatgacaaacatacgaacgccggaccctcgacggggtccccctagacccgtacttccgtcccggcctcccaaagtcctagggccactaactccacgccctccccgtgcccatcactgggctccgagcctgaggatggaggctagactagttactcgaccagttcgtaagtcgaacgtagtcggacccttaaaaggtaaccacgttcgtaacgtttaccgggaacgttacgggggaaccctaaacgggtccaaccccggtttccgg

SEQ ID NO: 358589 - DNA, 548 bp, Homo sapiens
  misc_feature: GZ8MTXP02G1F6S.9.34.D01.1.454.CMB.2.raw
  modified_base (267)..(267): a, c, t, g, unknown or other
  misc_feature (267)..(267): n is a, c, g, or t
  modified_base (354)..(354): a, c, t, g, unknown or other
  misc_feature (354)..(354): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagcccgccctcagtgtctggggccccagggcagagggtcaccatctcgtgcactgggaagtagctccaacagtcggggcacgttangatgtacactggtaccaacaacttccagaacacgaccccaaagtcatcatttatgacaacatacgaagccgccctcgacgggtcccngcccgattctccggctccagtctggcacatcacgcctcccgtggcccatcacgtcgggcctccgacggctggagagtacggaggtctagacttagtactgacccgtagtcgtactgactaggtacggacctaagtaaccagttacgtccgttacggaacgttacgggacctaacggtacccgtacggttcccgg

SEQ ID NO: 358590 - DNA, 522 bp, Homo sapiens
  misc_feature: GZ8MTXP02H11VE.9.34.D01.1.454.CMB.2.raw
  modified_base (322)..(322): a, c, t, g, unknown or other
  misc_feature (322)..(322): n is a, c, g, or t
  modified_base (429)..(429): a, c, t, g, unknown or other
  misc_feature (429)..(429): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggcccccagggcagagggtcaccatctcgtgcactggaagtagctccaacatcggggcacgttatgatgtacactggtaccaacaacttccaggaaccacgacccccaaagtcatctatttangacaacatcgaagccggccctcgacggggtccctagcccgattcctcccggcctaccaagtctcggcacatcacgccctccctggccatcactggctcgagctgagntgagctgactatactgccagtcgtatcgacagtcggaccttaagtaacatcgttcgttacggaacgtcgggaacctaacggtccaaccgtccg

SEQ ID NO: 358591 - DNA, 618 bp, Homo sapiens
  misc_feature: GZ8MTXP02GHFK5.9.34.D01.1.454.CMB.2.raw
  modified_base (323)..(323): a, c, t, g, unknown or other
  misc_feature (323)..(323): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagcccgccctcagtgtctggggccccagggcagagggtcaccatctcgtgcactggaagtagctccaacagtcggggcacgttatgatgtacactggtaccaacaacttccaggaacacgacccccaaagtcatctatttangaacaacatcgaacgccgccctcgacggggtccctgaccgtattccgtccggctaccaagtctggacacatcacgccctcccgtgcccatccacgtcgggcctccgaggcgtggagataggacgtcgtagtaacttagtttaaccgcgtacccgtaaggttccgttaagtacggtaaccgtacggtacgggtaacccttaaaacggtaaacctacgtttaccggttaaccgtttaccgggtaaaccggttacggggtaaacccgtaaacgggttcccgtaacccggtttcccggg

SEQ ID NO: 358592 - DNA, 523 bp, Homo sapiens
  misc_feature: GZ8MTXP02JSDFK.9.34.D01.1.454.CMB.2.raw
  modified_base (323)..(323): a, c, t, g, unknown or other
  misc_feature (323)..(323): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcacgtggaagtagctccaacagtcggggcacgttatgatgtacactggtaaccaacaacttccaggaacacgacccccaaagtcatcatttangacaacatcgaagccgccctcgacggggtcccctgaccgtattccgtccggctaccaagtctggcacatcacgccctcccgtggcccatccacgtcgggcctccgaggctggagatggagctgacttatactgcctagtctatgacaggtcgacctaagacagtcgtcgttacggaacgtcggaccacggtccaccgtcg

SEQ ID NO: 358593 - DNA, 528 bp, Homo sapiens
  misc_feature: GZ8MTXP02HCOM9.9.34.D01.1.454.CMB.2.raw
  modified_base (316)..(316): a, c, t, g, unknown or other
  misc_feature (316)..(316): n is a, c, g, or t
  modified_base (358)..(358): a, c, t, g, unknown or other
  misc_feature (358)..(358): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgcctcagtgtctggggccccagggcagagggtcaccatctcgtgcactggaagtagctccaacatcggggcacgttatgatgtacactggtaccaacaacttccaggaacagcccccaaagtcatcatttangacaacatcgaagcgccctcgacggggtccctgaccgattcnccggctccaagtctggcacactcacgccctcccgtggccatcacgtcggcctccgaggctgagatgagctgactatactgcctagtcgtatcggactaggtaggacttaaacgtacaagttcgtaacgtttacggaaactcggggaaccaacggtccaaccggttcccgg

SEQ ID NO: 358594 - DNA, 574 bp, Homo sapiens
  misc_feature: GZ8MTXP02HQH8H.9.34.D01.1.454.CMB.2.raw
  modified_base (321)..(321): a, c, t, g, unknown or other
  misc_feature (321)..(321): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacggttatgatgtacactggtaccaacaacttccaggaaccagacccccaaagtcatcatttanagacaacatagaagccgccctacgacggggtcccctggaccgtattcctcccggcctacccgaagtcctcggccaacactcacgtccctccctcggcccaatccgacgtcgggcctccgagctgagatggagctagactattactgacctagtacgtatcgacgtagtcggtaaccctaaagtaactaagttccgttaaccgtttacgggaacgttcgggaaacccgtaacggtaccgtaacccggttcccgg

SEQ ID NO: 358595 - DNA, 558 bp, Homo sapiens
  misc_feature: GZ8MTXP02IU7VR.9.34.D01.1.454.CMB.2.raw
  modified_base (325)..(325): a, c, t, g, unknown or other
  misc_feature (325)..(325): n is a, c, g, or t
  modified_base (357)..(357): a, c, t, g, unknown or other
  misc_feature (357)..(357): n is a, c, g, or t
  modified_base (376)..(376): a, c, t, g, unknown or other
  misc_feature (376)..(376): n is a, c, g, or t
  modified_base (547)..(547): a, c, t, g, unknown or other
  misc_feature (547)..(547): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccgcttcatcatctccagagacaattcccagaacatactgtctctgcaactcaataacctgagaggcgaggacacggccatttattctgtgcgaaggngcatatggaagtacgattttcgatccctcgcngtcgacactttgattacgngggggccgggaacccgtggtcgccgtcgtcctcacgccctccaccgaacgggcccactccggtccttccccctcggccacccctcctacccaacgacgccaccctcgtcgggggcacgacgccggccgtgggctcgccgtcggtacaaggactaaccgttccagacgtacncacgtagacgg

SEQ ID NO: 358596 - DNA, 584 bp, Homo sapiens
  misc_feature: GZ8MTXP02JBNSN.9.34.D01.1.454.CMB.2.raw
  modified_base (233)..(233): a, c, t, g, unknown or other
  misc_feature (233)..(233): n is a, c, g, or t
  modified_base (250)..(250): a, c, t, g, unknown or other
  misc_feature (250)..(250): n is a, c, g, or t
  modified_base (289)..(289): a, c, t, g, unknown or other
  misc_feature (289)..(289): n is a, c, g, or t
  modified_base (326)..(326): a, c, t, g, unknown or other
  misc_feature (326)..(326): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (403)..(403): a, c, t, g, unknown or other
  misc_feature (403)..(403): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccaganacaattcccagaacatactgtctctgcaactcaataccngagaggcgaggacacgctatttattctgtgcgaaggngcatagtaggaactacgtatttcgactcccncgcngtcgactacttgagttacgcgggggacccggtacctggtccnccgtctcctgacgccctacccgacgaacgggcccagttccgggtcccttcccccgagccctacccctccgtacccaacggacgccctaccgtcgggcggggacccaacgcggccggtcccgtgggcctcgccgtcggtaccgaaggtccctcgttacgacgtacgtatccgacgcggacgg

SEQ ID NO: 358597 - DNA, 573 bp, Homo sapiens
  misc_feature: GZ8MTXP02HABSS.9.34.D01.1.454.CMB.2.raw
  modified_base (231)..(231): a, c, t, g, unknown or other
  misc_feature (231)..(231): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggccatttatttctgtgcgaaggaggcatatgggaagtacgattttcgatccctcgcagtcgacactttgattacgtgggggcccgggaacctggtcgccgtctcctcagccctcaccgaacggcccatccggtccttccccctcggccacccctccctacccaacgacgccacctccgtgggggccaacgcggccggcccccgttggggccttggccccgtgggtaccgaacggtactaacttccaacggtacgtactcacctggacgg

SEQ ID NO: 358598 - DNA, 556 bp, Homo sapiens
  misc_feature: GZ8MTXP02GN91C.9.34.D01.1.454.CMB.2.raw
  modified_base (363)..(363): a, c, t, g, unknown or other
  misc_feature (363)..(363): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgactccctccgnagtcgactactttgattacgtgggggcccgggtaaccctggtccgccgtctcctcagccctccaccaagggcccagtccggtccttcccccgtggccacccctccctaccaacgcgccaccctcgtcgggggcacgacgcggccccgtgggcctggcctcggcaaggctaacgtccagacgtatcacgtgacg

SEQ ID NO: 358599 - DNA, 577 bp, Homo sapiens
  misc_feature: GZ8MTXP02IFE9Y.9.34.D01.1.454.CMB.2.raw
  modified_base (317)..(317): a, c, t, g, unknown or other
  misc_feature (317)..(317): n is a, c, g, or t
  modified_base (335)..(335): a, c, t, g, unknown or other
  misc_feature (335)..(335): n is a, c, g, or t
  modified_base (383)..(383): a, c, t, g, unknown or other
  misc_feature (383)..(383): n is a, c, g, or t
  modified_base (463)..(463): a, c, t, g, unknown or other
  misc_feature (463)..(463): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaaataacctgagaggcgaggacacggccatttattcngtgcgaaggaggcatagnggaacgtacgtatttcgactcctcgcagtcgactactttgatttacgnggggacccgggaaccctggtcgccgtctcctcacgcctccaccgaaggcccatccggtccttccccgtgccaccctcccnccaagcgccaccgtcgtcggggccaacgcgccggccccgtggggcctacggcccgtaggtccgaaacggtaccctaacttcccgaaggtacccgtaattccaacgttgaccggg

SEQ ID NO: 358600 - DNA, 584 bp, Homo sapiens
  misc_feature: GZ8MTXP02FQSC5.9.34.D01.1.454.CMB.2.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaaataacctgagaggcgaggacacggcctatttattctgtgcgaaggaggcatagtgggaagtacgatttcgatccctcgcagtcactactttgattacgtgggggcccgggaaccctggtcgccgtctcctcacgcctccaccgaacgggcccatccggtccttcccccgtggcccacccctcctaccaacgacgccaccgtcgtcgggggccacgacggccggccccgtggggccttcggcccgtgggtaccaacgggtacctaaccttcccgaagtaccgtataccgaacgtggaacggg

SEQ ID NO: 358601 - DNA, 576 bp, Homo sapiens
  misc_feature: GZ8MTXP02J2105.9.34.D01.1.454.CMB.2.raw
  modified_base (249)..(249): a, c, t, g, unknown or other
  misc_feature (249)..(249): n is a, c, g, or t
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
  modified_base (392)..(392): a, c, t, g, unknown or other
  misc_feature (392)..(392): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcaggaggtcaccatctcgtgcactggaagtagctcaacngtcggggctacgttatgatgtacactgtaccaacaactcaggaacacgaccccaaagtcatctattangactanatgaacgcgccctacgcgggtccctggacctatcctccggctaccaagtctggcacatcacgccctccnggccatcacgtggctccgagtcaggaggatcgggaggtcctaggtaacttacgttaacgttcggacctaaacggtcgttagacggactacgggtacggtaacctaaacggtaactacgtttaccgtaaccggtttaacggaaccggttacgggaaccctaacgggttacccgaccgttcccggg

SEQ ID NO: 358602 - DNA, 510 bp, Homo sapiens
  misc_feature: GZ8MTXP02I9R2O.9.34.D01.1.454.CMB.2.raw
  modified_base (315)..(315): a, c, t, g, unknown or other
  misc_feature (315)..(315): n is a, c, g, or t
  modified_base (440)..(440): a, c, t, g, unknown or other
  misc_feature (440)..(440): n is a, c, g, or t
  modified_base (474)..(474): a, c, t, g, unknown or other
  misc_feature (474)..(474): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagaggtcaccatctcgtgcactggagtagctccaacatcggggcacgttatgatgtacactggtaccaacaacttccaggaacagccccaaagtcatcatttangacaacatgaacgccgccctacgacggggtccctgccgattccgtaccggctccaagtctggcacatcagcctccctgcccatcactcgggctccgaggcctggagactggagctgactattacngaccagtcgtatcgacacggtcgactaagtaacntacgtcgtcggaacgtcgggaccacggtccacgtcg

SEQ ID NO: 358603 - DNA, 576 bp, Homo sapiens
  misc_feature: GZ8MTXP02FZL1K.9.34.D01.1.454.CMB.2.raw
  modified_base (303)..(303): a, c, t, g, unknown or other
  misc_feature (303)..(303): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgaggggagggactggagtgggtcgcaggcatcgctgggtggcggtcatgacacattctacgcaaactccgtgaggggccncttcatcatctccagagacaattcccagaacatactgtctctgcaacctcaaataacctgagaggcgaggacacggcctattttatttcgtgtgacgaagggaggcaagtagtaggggaaagtacgtattttcgattcccctcgcagtcgactagtttggttacgtgggggcccgggacctgggtcgccgtctcctcacgcctaccaccgaacgggcccacgtccggtcccttcccccgtggccctacccctcctaccaagcgccaccgtcgg

SEQ ID NO: 358604 - DNA, 588 bp, Homo sapiens
  misc_feature: GZ8MTXP02I4RCW.9.34.D01.1.454.CMB.2.raw
  modified_base (320)..(320): a, c, t, g, unknown or other
  misc_feature (320)..(320): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcacgtggaagtagctccaacagtcggggcacgttatgatgtacactggtaccaacacttccaggaacacgaccccaaagtcatcatttangacaacatacgaacgccgccctcgacggggtcccctgaccgattccgccgcctccaagtctggcacactcacgccctcccgtggcccatccacgtcgggcctccgacggtcctaggaggactggacggcctagtactagttacgtcgacctagttccgtagttacggaacgtacgtacgggtacccttaaaaggtaacctaagttccgttaacgtaccgggtaaacgttacggggaaaccctaacggggtcctaacccggtttcccgg

SEQ ID NO: 358605 - DNA, 613 bp, Homo sapiens
  misc_feature: GZ8MTXP02JH91W.9.34.D01.1.454.CMB.2.raw
  modified_base (365)..(365): a, c, t, g, unknown or other
  misc_feature (365)..(365): n is a, c, g, or t
  modified_base (462)..(462): a, c, t, g, unknown or other
  misc_feature (462)..(462): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatagtgggaagtacgattttcgactccctccgcngtcgactactttgatttacgtgggggacccggggtaaaccctgggtcgcccgtctccctcacgccctccgaccaagggccccatccggtccttcccncttcggccaccccgtcctcccaaagtcgcacctcggtcgggggcacgacggccggcccctgggggccctcggtcccgtcggggttaccaaaacggggtaacccttaaccgtttcccgaacggtacccggttaacttcccgaaagttcgggg

SEQ ID NO: 358606 - DNA, 467 bp, Homo sapiens
  misc_feature: GZ8MTXP02F4BIH.9.34.D01.1.454.CMB.2.raw
  modified_base (336)..(336): a, c, t, g, unknown or other
  misc_feature (336)..(336): n is a, c, g, or t
  modified_base (442)..(442): a, c, t, g, unknown or other
  misc_feature (442)..(442): n is a, c, g, or t
  modified_base (456)..(456): a, c, t, g, unknown or other
  misc_feature (456)..(456): n is a, c, g, or t
  modified_base (461)..(467): a, c, t, g, unknown or other
  misc_feature (461)..(467): n is a, c, g, or t
tcagtgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggacctaaagtaacntcgtcttccggaactgggaccaaggtcaccgtcgtgggcagacccaagcccaacccatgtccacttcctcgttccccaccctcctcagtactatcactgagcgggntcgggcaagggcanagagnnnnnnn

SEQ ID NO: 358607 - DNA, 635 bp, Homo sapiens
  misc_feature: GZ8MTXP02GP807.9.34.D01.1.454.CMB.2.raw
  modified_base (233)..(233): a, c, t, g, unknown or other
  misc_feature (233)..(233): n is a, c, g, or t
  modified_base (336)..(336): a, c, t, g, unknown or other
  misc_feature (336)..(336): n is a, c, g, or t
  modified_base (431)..(431): a, c, t, g, unknown or other
  misc_feature (431)..(431): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccaagaacatactgtctctgacaactcaaataacctgagaggcgaggacacggacctatttatttctgtgacggaaggngacatagtagggaagtacgtattttcgactccctccgcagtcgaactactttgattacggtgggggacccggggtaacctggtccgccgtctccncacgccctccaaccgacggcccagtccggtcccttcccccgtcggcccacccctacctaccgaaacgcgaccctaccgtcggtcgggggaccacgaccggcccgggtccccgtgggggtcctcggtcccgtacgggtaccgaaacgggtaccctttaaccgttacccgaacggtaccgttactaccgtaaccgtcgggaccggg

SEQ ID NO: 358608 - DNA, 562 bp, Homo sapiens
  misc_feature: GZ8MTXP02G7GU1.9.34.D01.1.454.CMB.2.raw
  modified_base (321)..(321): a, c, t, g, unknown or other
  misc_feature (321)..(321): n is a, c, g, or t
  modified_base (388)..(388): a, c, t, g, unknown or other
  misc_feature (388)..(388): n is a, c, g, or t
  modified_base (405)..(405): a, c, t, g, unknown or other
  misc_feature (405)..(405): n is a, c, g, or t
  modified_base (528)..(528): a, c, t, g, unknown or other
  misc_feature (528)..(528): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgagggggagggactggagtgggtcgcaggcatcgctgggtggcggtcatgacacattctacgcaaactccgtgacgggccgcttcatcatctccaganacaatcccagaacatactgtctctgcaacctcaaatacctgagagcgaggacacggctatttattcngtgcgaaggagcatagngggaagtacgatttcgatccctcgcagtcgactacttgattacgcgggggacccggaaccgtcggtcgccgtctcctcacgccctaccgaccgaacggcccacgtcccggtcctttcccccgnggcccaccccgtcctaccgaacgaccgctacccg

SEQ ID NO: 358609 - DNA, 572 bp, Homo sapiens
  misc_feature: GZ8MTXP02HFVT4.9.34.D01.1.454.CMB.2.raw
  modified_base (232)..(232): a, c, t, g, unknown or other
  misc_feature (232)..(232): n is a, c, g, or t
  modified_base (330)..(330): a, c, t, g, unknown or other
  misc_feature (330)..(330): n is a, c, g, or t
  modified_base (366)..(366): a, c, t, g, unknown or other
  misc_feature (366)..(366): n is a, c, g, or t
  modified_base (524)..(524): a, c, t, g, unknown or other
  misc_feature (524)..(524): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgagggccncttcatcatctccagagacaattcccagaacatactgtctctgcaactcaaataacctgagaggcgaggacacggcctatttattctgtgacgaaggnggcatatgggaactacgtatttcgaactccctccgnagtccactactttgacttacgtgggggacccggggaccctggtccgccgtctcctcacgcctccaccgaacggcccacgtccggtcccttcccccgtcggcccacccctcctacccaacgacgaccacctcgtcggggcacgacgccggccgtgggcncgccgtcgtacaacggactaacgtccacgtacgtactcacgtcgacgg

SEQ ID NO: 358610 - DNA, 600 bp, Homo sapiens
  misc_feature: GZ8MTXP02JODSY.9.34.D01.1.454.CMB.2.raw
  modified_base (318)..(318): a, c, t, g, unknown or other
  misc_feature (318)..(318): n is a, c, g, or t
  modified_base (363)..(363): a, c, t, g, unknown or other
  misc_feature (363)..(363): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggctatttattcngtgcgaaggagcatagtggaacgtacgtatttcgactccctcgcngtcgactacgtttgattacgcgggggccgggaacctggtccgccgtctccctcacgccctccaccgaacgggcccacgtccggtcccttcccccgtggccctacccctccctacccgaaagccgccctaccgtcggtcgggggaccacgacggccggccccgtggggccctcggcccgtcgggtaccaacggtaccttaacgttacccgaaggtacgtactccgtaggacggccggg

SEQ ID NO: 358611 - DNA, 498 bp, Homo sapiens
  misc_feature: GZ8MTXP02GLB7Y.9.34.D01.1.454.CMB.2.raw
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcgccctcgaggggtccctgccgattctccggctccaagtctggcacatcagccctccctggccatcactcggctccaggctgagatgagctgactatactgccagtcgtatgacagtggacctaagtaacatcgtcgttacggaactcgggaccaaggtccacgtccgg

SEQ ID NO: 358612 - DNA, 547 bp, Homo sapiens
  misc_feature: GZ8MTXP02GTEL3.9.34.D01.1.454.CMB.2.raw
  modified_base (232)..(232): a, c, t, g, unknown or other
  misc_feature (232)..(232): n is a, c, g, or t
  modified_base (358)..(358): a, c, t, g, unknown or other
  misc_feature (358)..(358): n is a, c, g, or t
  modified_base (481)..(481): a, c, t, g, unknown or other
  misc_feature (481)..(481): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggcatttattctgtgcgaaggagcatagtggaagtacgatttcgatccctcgcngtcgactactttgattacgtcgggggcccgggaaccctggtccgccgtctcctcacgccctccaccgaacgggcccagtccgtccttccccctggccacccttccaccaagacgccacctcgnggggccacgacgccggccctgggcctgccctggtacaaggctaacgtcacgacgtatcactgacgg

SEQ ID NO: 358613 - DNA, 573 bp, Homo sapiens
  misc_feature: GZ8MTXP02F1OMH.9.34.D01.1.454.CMB.2.raw
  modified_base (232)..(232): a, c, t, g, unknown or other
  misc_feature (232)..(232): n is a, c, g, or t
  modified_base (385)..(385): a, c, t, g, unknown or other
  misc_feature (385)..(385): n is a, c, g, or t
  modified_base (456)..(456): a, c, t, g, unknown or other
  misc_feature (456)..(456): n is a, c, g, or t
  modified_base (492)..(492): a, c, t, g, unknown or other
  misc_feature (492)..(492): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggaatggagtgggtcgcaggcatcgctggtggcggtcatgacacattctacgcaaactccgtgaggggccncttcatcatctccagagacaattcccagaacatactgtctctgcaactcaataacctgagaggcgaggacacggcctatttattctgtgcgaaggagcatagtgggaagtacgtattttcgactccctccgcagtcgactactttgattacgngggggcccgggtaacctggtccgccgtctcctcacgccctccacgacgggcccatccggtcccttccccgnggcccacccctcctaccaaacgcgccacccgttcgnggggccaacgcggccggccctggggcctcggcccgtggtaccaaggtacctaaccgttcacgtaccgtatccgactgacgg

SEQ ID NO: 358614 - DNA, 593 bp, Homo sapiens
  misc_feature: GZ8MTXP02JLIWW.9.34.D01.1.454.CMB.2.raw
  modified_base (364)..(364): a, c, t, g, unknown or other
  misc_feature (364)..(364): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatagtgggaacgtacgattttcgatccctcgcngtcgacactttgattacgtggggcccggggaaccctggtccgccgtctcctcacgccctccaccgaacgggccccagtccggtccctttcccccgtaggcccacccctccgtacccaagacgccaccgtcgtgggggaccacgacggccggccctggggcctcggcccgtcgggtaccgaacgggtacctaaccgttacccgagtaaccgtactccgaactggaccggg

SEQ ID NO: 358615 - DNA, 528 bp, Homo sapiens
  misc_feature: GZ8MTXP02GU9GZ.9.34.D01.1.454.CMB.2.raw
  modified_base (320)..(320): a, c, t, g, unknown or other
  misc_feature (320)..(320): n is a, c, g, or t
  modified_base (455)..(455): a, c, t, g, unknown or other
  misc_feature (455)..(455): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacagtcggggcacgttatgatgtacactggtaccaacaacttccaggaacacgaccccaaagtcatcatttangaacaacatacgaacgcgccctcgacggggtccctagccgtattcctccggctccaagtctggcacatcacgccctccctggcccatccacgtcgggcctccgaggctaggaggatggaggcctagactattacngccagtcgtatgacagtcgacctaagtactagtcgtcgttacggaacgtcggaaccaacggtcctaccgtccg

SEQ ID NO: 358616 - DNA, 549 bp, Homo sapiens
  misc_feature: GZ8MTXP02F2Z3F.9.34.D01.1.454.CMB.2.raw
  modified_base (319)..(319): a, c, t, g, unknown or other
  misc_feature (319)..(319): n is a, c, g, or t
  modified_base (360)..(361): a, c, t, g, unknown or other
  misc_feature (360)..(361): n is a, c, g, or t
  modified_base (482)..(482): a, c, t, g, unknown or other
  misc_feature (482)..(482): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccataacatactgtctctgcaactcaataacctgagaggcgaggacacggcctatttatttcngtgcgaaggagcatatgggaatacgatttcgatccctccgnngtcacactttgattacgtggggccgggaaccctggtccgccgtctcctcacgcctccaccgaacgggcccatccggtccttcccccgtggccacccctcctaccaacgacgcaccgttcgngggggccacgacgccggccctgggcctgccgtcgtcaaggactaactccagacgtatcactcgacgg

SEQ ID NO: 358617 - DNA, 523 bp, Homo sapiens
  misc_feature: GZ8MTXP02F68TC.9.34.D01.1.454.CMB.2.raw
  modified_base (319)..(319): a, c, t, g, unknown or other
  misc_feature (319)..(319): n is a, c, g, or t
  modified_base (484)..(484): a, c, t, g, unknown or other
  misc_feature (484)..(484): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctgggccccagggcagagggtcaccatctcgtgcactggaagtagctccaacatcggggcacggttatgatgtacactggtaccaacaacttccaggaacacgaccccaaagtcatcatttangacaacatcgaagccggccctcgacggggtcccctgacccgtattccgtccggctccaagtctggcacactcacgccctccctcggccatcacgtgggcctccaggctgagatggagctgactattactgacctagtcgtaatgacaggtcggaccttaagaacntcgtcgttacggaacgtcgggaccaaggtccacgtccgg

SEQ ID NO: 358618 - DNA, 710 bp, Homo sapiens
  misc_feature: GZ8MTXP02F28W4.9.34.D01.1.454.CMB.2.raw
  modified_base (254)..(254): a, c, t, g, unknown or other
  misc_feature (254)..(254): n is a, c, g, or t
  modified_base (322)..(322): a, c, t, g, unknown or other
  misc_feature (322)..(322): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagcccgccctcagtgtctcggggccccagggcaggagggtcaccatctcgtgcactggaagtagctaccaacntcgggcacgttatgatgtacactcgtaaccaacactccaggaacacgaccccaaagtcatacatttangacaacatacgaagccgcctcgacgggtccctgaccgacttccgccggacctacctaagtctaggaccactactccgacgtcccctcccgtacggcccctaattcccgaacgttcgggcccttacccgaacgggtccgttacgggaacgggtattacggggaacggtcccgttaaggtaacctttaaacggtttaacccgcggtacccccgttaaaggttaccggttaaaacttcgggtaaaaccccgtaggggttaaccgggtaacccctttaaaaacgggttaaaacctacgtttaccggttaacccgttttaccgggggaaaaccgtttaccgggggaaaaccccgtaaaacggggtttccccgtaacccggtttaaccccgggg

SEQ ID NO: 358619 - DNA, 768 bp, Homo sapiens
  misc_feature: GZ8MTXP02FVFXG.9.34.D01.1.454.CMB.2.raw
  modified_base (371)..(371): a, c, t, g, unknown or other
  misc_feature (371)..(371): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgcccgccctcagtcgtcgtccggggccccgagggcaggacgggtccacctatcctcgtgacacgtaggaagtacgcctaccaaacgaggtccggggactaacgttatagtattacgtaactacgtacggtaaacccaaactaaccttaccgaacggaaccaccgacccccaaagtcaatactatttanacgaacaactatacgaacgccgtacccgtacggtacggggtccctacgaccgtacttccgtccggacctaccgtaacgtcgtacggaccactactcgaccgtccccttacccgtcggaccctaacgtcccgacggtccgggacctacccgagggtccgtaggaacggtagttagggacgtaccgtagtaacctttaacgtttaccgacggtacccgtaaggttaccggttaaagttaccggaaacgttacgggtaaccgggttaaaccctttaaaaacggttaaaaccctcggttttaaccccgggtttaaccggttaaaacccggggtaaaccggttaaccgggggaaaccccgttaaaaccggggttccccgtaaacccgggttttaccccgggg

SEQ ID NO: 358620 - DNA, 628 bp, Homo sapiens
  misc_feature: GZ8MTXP02IOP9I.9.34.D01.1.454.CMB.2.raw
  modified_base (328)..(328): a, c, t, g, unknown or other
  misc_feature (328)..(328): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaaataacctgagaggcgaggacacggccatttattctgtgcgaaggngcatagtgggaatacgatttcgattccctcgctagtcgactactttgactttacgcgggggacccggggaaacccgtcggtccggcccgtccgtcctccgacgccctacccaaccgaaaccgggccctacgtccggttcccttcccccgtcggtcccaccccgtccctacccgaaacgacgcccgaaccctcggtcgggggaccaccgacggcccggcccgtcggggcctcggcccgtcggtaccgaaacggaccttaaccgttaccgaacgtaccgtacgtaccgaacgtcggaacggg

SEQ ID NO: 358621 - DNA, 561 bp, Homo sapiens
  misc_feature: GZ8MTXP02J29LW.9.34.D01.1.454.CMB.2.raw
  modified_base (263)..(263): a, c, t, g, unknown or other
  misc_feature (263)..(263): n is a, c, g, or t
  modified_base (318)..(318): a, c, t, g, unknown or other
  misc_feature (318)..(318): n is a, c, g, or t
  modified_base (434)..(434): a, c, t, g, unknown or other
  misc_feature (434)..(434): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgcctcagtgtctgggccccagggccagagggtcaccatctcgtgcactggaagtagctccaacagtcggggcacgttangatgtacactggtaccaacaacttccaggaacagaccccaaagtccatcatttangaacaacatgaacgcggccctcgacggggtccctggccgattccgtccggctaccgaagtcctggcaacatcacgccctccctggccatcacgtcgggctccgaggctaggagagnggagtctagtacttattacgtcgaccgtagtcgttacgtacgacgtacggtacgtaacctaacgtaaccgtacgttaccgtaacgttacggaacgtacgggtaaccgtacggtacccgtaccggtcg

SEQ ID NO: 358622 - DNA, 611 bp, Homo sapiens
  misc_feature: GZ8MTXP02HR6M6.9.34.D01.1.454.CMB.2.raw
  modified_base (232)..(232): a, c, t, g, unknown or other
  misc_feature (232)..(232): n is a, c, g, or t
tcagtgatacgtctcacgaccggtgctcgatttagatcgtctgtgttggggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccncttcatcatctccagagacaattcccaagaacatactgtctctgcaactcaaataacctgagaggcgaggacacggcctattttattctgtgacgaaggaggcagtagtaggggaacgtacgtattttcgacttcccgtccgctgtcgactactttgacttacggtggggcccgggtaacctggtccgccgtctccctcacgccctccaccgaacgggcccagtccggtccttacccccgtggccctacccctccgtacccaagaccgccaccgtcggcggggccacgacggcccggtcccgtggggcctcggtcccgtacgggtaccaaacggtacctaacccgttccgaacgtaccgtactccgaacgtcggaccgg

SEQ ID NO: 358623 - DNA, 535 bp, Homo sapiens
  misc_feature: GZ8MTXP02JW4P8.9.34.D01.1.454.CMB.2.raw
  modified_base (321)..(321): a, c, t, g, unknown or other
  misc_feature (321)..(321): n is a, c, g, or t
  modified_base (351)..(351): a, c, t, g, unknown or other
  misc_feature (351)..(351): n is a, c, g, or t
  modified_base (457)..(457): a, c, t, g, unknown or other
  misc_feature (457)..(457): n is a, c, g, or t
  modified_base (467)..(467): a, c, t, g, unknown or other
  misc_feature (467)..(467): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctaccaacagtcggggcacgttatgatgtacactggtaaccaacacttccaggaacacgaccccaaagtcatcatttangacacatcgagccgcctcgacggggtcccngaccgtacttccgtccggctaccaagtcctacgggcactatcacgtccctcccgtggccactcgacgtcgggctccgaggctggagatggagctagactagttacncgcagtctancgactcggtacgactaacgtactacgtccgtaacgtacggaacgtcggaaccacggtccgtaccgtcg

SEQ ID NO: 358624 - DNA, 579 bp, Homo sapiens
  misc_feature: GZ8MTXP02FIM4F.9.34.D01.1.454.CMB.2.raw
  modified_base (305)..(305): a, c, t, g, unknown or other
  misc_feature (305)..(305): n is a, c, g, or t
  modified_base (322)..(322): a, c, t, g, unknown or other
  misc_feature (322)..(322): n is a, c, g, or t
  modified_base (391)..(391): a, c, t, g, unknown or other
  misc_feature (391)..(391): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgagggggagggactgggagtgggtcgcaggcatcgctggtggcggtcatgacacattctacgcaaactccggtgaggggccncttcatcatctccaganacaattcccagaacatactgtctctgcaacctcaatacctgagaggcgaggacacggcctatttattcngtgcgaaggagcatagtagggaagtacgtatttcgatcccgtcgcagtcgactacgtttggttacgtgggggcccgggaacctcggtcgccgtctcctcgacgccctccgaccgaacgggccctacgtcccggttccttcccccgttcggccctacccctccctacccaacgacgcctaccgtccggg

SEQ ID NO: 358625 - DNA, 576 bp, Homo sapiens
  misc_feature: GZ8MTXP02JDZMK.9.34.D01.1.454.CMB.2.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgatttacgtgggggcccgggaacccgtgggtccgccgtctccctcacgccctccacccaacggggccccagtccggtcccttcccccgtcggcccaccccgttccctacccaagacgccacctcgtcggggcacgacgccggccctgggccgtcgcctcggtaccaacggactaacgttccagacgtactccacgtcgacgg

SEQ ID NO: 358626 - DNA, 613 bp, Homo sapiens
  misc_feature: GZ8MTXP02JORIA.9.34.D01.1.454.CMB.2.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccaagaacatactgtctctgcaactcaataacctgagaggcgaggacacggcctatttattctgtgacggaaggaggcagtagtagggaaacgtacgtattttcgacttcccgtccgctgtccgactactttgattacggtcgggggacccggggtaacccgtggtccgccgtctccctcacgcctaccaccgaacggcccacgtccggtccttccccgcggccctaccctcctaccaacgacgccaccgtcggtcgggggaccacgacggcccggcccgtggggcctcggcccgtcggtaccgaacggtaccttaaccgttcccgaaggtaccgtacgtacctaccgtggaccggg

SEQ ID NO: 358627 - DNA, 606 bp, Homo sapiens
  misc_feature: GZ8MTXP02JNRUV.9.34.D01.1.454.CMB.2.raw
  modified_base (334)..(334): a, c, t, g, unknown or other
  misc_feature (334)..(334): n is a, c, g, or t
  modified_base (423)..(423): a, c, t, g, unknown or other
  misc_feature (423)..(423): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgccgccctcagtcgtcgtcggggccccagggcaggagggtcaccatctcgtgcacgtggaagtagctaccaacagtcggggctacgttatgatgtacacgtaggtaaccaacaacttccgaggaaccacgaccccaaagtcatctatttanagaacaacatacgaacgccgaccctcgacggggtcccagaccgtattccgccggctaccaagtctggacacgatccacgcccttcccgngcccatccacgtcggcctacgaggctaggaggatggacggcttacggaacttacgttacgtcgaccgtagtaccgtagtcgtaacgtacggttacggaacccttaaaagtaacctacgttaccgttaacgtaccgggtaaacgttacggggaaacctaacggttacccgaaccggtttcccgg

SEQ ID NO: 358628 - DNA, 568 bp, Homo sapiens
  misc_feature: GZ8MTXP02HIBUY.9.34.D01.1.454.CMB.2.raw
  modified_base (382)..(382): a, c, t, g, unknown or other
  misc_feature (382)..(382): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaaataacctgagaggcgaggacacggccatttattctgtgcgaaggaggcatatgggaatacgattttcgatccctcgcagtcgactactttgatttacgnggggacccggggaaccctggtccgccgtctccctcacgccctccaccgaacgggccccagtccggtccttccccctggcccaccctcctacccaagacgccacccgtcgtcggggccacgacgccggcccgtgggcctcggcctcggtaccaaggacctaaccgttcacgacgtatccactgacgg

SEQ ID NO: 358629 - DNA, 528 bp, Homo sapiens
  misc_feature: GZ8MTXP02G6BWO.9.34.D01.1.454.CMB.2.raw
  modified_base (327)..(327): a, c, t, g, unknown or other
  misc_feature (327)..(327): n is a, c, g, or t
  modified_base (464)..(464): a, c, t, g, unknown or other
  misc_feature (464)..(464): n is a, c, g, or t
  modified_base (480)..(480): a, c, t, g, unknown or other
  misc_feature (480)..(480): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggnggcatatgggaagtacgattttcgatccctcgcagtcgacactttgattacgtgggggcccggggaaccctggtcgccgtctcctcagccctcaccaagggcccatcggtcctccctggccaccctcctccaagacncactcgtggggcacgngccgccctggctgcctcgacaggactaactcacgacgtatcactgagg

SEQ ID NO: 358630 - DNA, 532 bp, Homo sapiens
  misc_feature: GZ8MTXP02I7OLA.9.34.D01.1.454.CMB.2.raw
  modified_base (309)..(309): a, c, t, g, unknown or other
  misc_feature (309)..(309): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgcctcagtgtctgggccccagggcagagggtcaccatctcgtgcactggaagtagctccaacatcgggcacgttatgatgtacactgtaccaacacttcaggacacgccccaaagtcatcattangacaacatacgaacgcggccctcgaggggtcccctgaccgtacttcgtcccggctccaagtctacggcacactcacgccctcccgtgacccatcacgtcggctccgagctgagatgagcgtgactatactcacagtacgtatacgaccagtacggtacctaacgtaactaacgtacgtcgtacggtaacgttacggaccgaacggtaccgtaaccgttcccgg

SEQ ID NO: 358631 - DNA, 662 bp, Homo sapiens
  misc_feature: GZ8MTXP02J1URU.9.34.D01.1.454.CMB.2.raw
  modified_base (339)..(339): a, c, t, g, unknown or other
  misc_feature (339)..(339): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacgagggtcctgggcccagtctgttctgacgcagccgcctcagtgtcgtcgggccccagggcaggacggtcaccgatctcgtgcacgtagggaagtacgcctaccaacgacgtcggggctacgttatgatgtacacgtcggtaaccaactaaccttccaaggaaccacgaccccaaagtcatctattanagaactaacatacgaacgccggtaccctacgacggggtaccctacgccgtacttccgtcccggctaccgtaagtcctacgggaccaacgtactcccgaccgtccccgtacccgtcggaccctaacgttccgaccgtcgggtacctaccggacggtcgtaggacggtactgggacggtctacggtaaccttagttaccgcgtaccgtaggttacgtacgtacgtaacgacgggttacgaacccgttaaagtaaccgtaccgttaccggtaacgttaacggaaccgttacgggaaacccgtaacggtcccgtaaccggtttccgg

SEQ ID NO: 358632 - DNA, 805 bp, Homo sapiens
  misc_feature: GZ8MTXP02HM2SM.9.34.D01.1.454.CMB.2.raw
  modified_base (233)..(233): a, c, t, g, unknown or other
  misc_feature (233)..(233): n is a, c, g, or t
  modified_base (321)..(321): a, c, t, g, unknown or other
  misc_feature (321)..(321): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccagaacatactgtctctgcaactcaaataacctgagaggcgaggacacggcctatttatttcngtgcgaaggagactataggtagggaactacgtagttttcgacttccccgtaccgacgtacggtccgtaaacttacgttttagtaaacgtttaccggggccggggggtacccccgggggtaaacccgttcggggtccccggttcccggttcccttccccgacgtaacccgtcccccgtaccccgaaacccgggaaaccggggtccccctaagtttccccgggtttcccccttccccccgtcgggtaccccctaacccccgttcccctaaacccgaaacggtacccgaccccgtaacccgttcgggggtaccgggggacccaaaaccgggtaccgggccccgggtacccccgggttcgggggccctttaacccggggccccgttttacgggggaaacccgtaaaaccggggttaccctttaaacccggtttcccgaaaaccgggttaaccgttaacttcccggaaaccggtttaggggacccgggg

SEQ ID NO: 358633 - DNA, 586 bp, Homo sapiens
  misc_feature: GZ8MTXP02I6X7E.9.34.D01.1.454.CMB.2.raw
  modified_base (232)..(232): a, c, t, g, unknown or other
  misc_feature (232)..(232): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggcatttattctgtgcgaaggagcagtagtggaagtacgtattttcgacttccctccgcagtccgactactttgacttacgtcgggggacccggggtaaccctggtccgccgtctccgtcacgccctccaaccgaacggcccacgtccggttcccttcccccgtcggtcccaccccttccgtacccaacgacgccaccgtcgtcgggggcacgacggccggcccgtgggcctcgcgtcggtacaaggtacctaacgtccgacgtacgtactcacgtcgacgg

SEQ ID NO: 358634 - DNA, 557 bp, Homo sapiens
  misc_feature: GZ8MTXP02IFJ9E.9.34.D01.1.454.CMB.2.raw
  modified_base (361)..(361): a, c, t, g, unknown or other
  misc_feature (361)..(361): n is a, c, g, or t
  modified_base (546)..(546): a, c, t, g, unknown or other
  misc_feature (546)..(546): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaaattcccagaacatactgtctctgcaactcaataacctgagaggcgaggacacggccatttatttctgtgcgaaggaggcatatgggagtacgattttcgatccctcgcngtcgacactttgattacgtgggggcccgggaacccgtggtcgccgtctcctcacgccctccaccaacgggcccatccggtccttccccctggccacccctcctcccaacgacgcaccgtcgtcgggggcacgacgccggccctggggcctcggcctcggtcaaggactaacgttccacgacgtanccactcgacgg

SEQ ID NO: 358635 - DNA, 479 bp, Homo sapiens
  misc_feature: GZ8MTXP02HL592.9.34.D01.1.454.CMB.2.raw
  modified_base (369)..(369): a, c, t, g, unknown or other
  misc_feature (369)..(369): n is a, c, g, or t
  modified_base (420)..(420): a, c, t, g, unknown or other
  misc_feature (420)..(420): n is a, c, g, or t
  modified_base (464)..(479): a, c, t, g, unknown or other
  misc_feature (464)..(479): n is a, c, g, or t
tcagtgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggacctaagtaacatcgtcttccggaactgggaccaaggtcaccgtcngggtcagcccaagcccaacccccatcgcactcctcgttccccgcccttccncacgacgtatcactgacggcgggctgggcaaggcgacacgtagnnnnnnnnnnnnnnnn

SEQ ID NO: 358636 - DNA, 550 bp, Homo sapiens
  misc_feature: GZ8MTXP02FV5P4.9.34.D01.1.454.CMB.2.raw
  modified_base (456)..(456): a, c, t, g, unknown or other
  misc_feature (456)..(456): n is a, c, g, or t
  modified_base (500)..(500): a, c, t, g, unknown or other
  misc_feature (500)..(500): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacacttccaggaacacgacccccaaagtcatcatttatagacaaacatcgaagccgaccctcgacggggtccctgaccgatctccggctaccaagtctggccacatcacgccctcccgtcggccatccacgtcgggcctccgaggtctggacggatggaggctagacttattacngacctagtcgtaatcggaactacggtcggtaacttaacgtaacncttacgtcgttacggaacgttcgggacctaacggtcctaaccggttccgg

SEQ ID NO: 358637 - DNA, 578 bp, Homo sapiens
  misc_feature: GZ8MTXP02IQIW6.9.34.D01.1.454.CMB.2.raw
  modified_base (267)..(267): a, c, t, g, unknown or other
  misc_feature (267)..(267): n is a, c, g, or t
  modified_base (319)..(319): a, c, t, g, unknown or other
  misc_feature (319)..(319): n is a, c, g, or t
  modified_base (369)..(369): a, c, t, g, unknown or other
  misc_feature (369)..(369): n is a, c, g, or t
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
  modified_base (468)..(468): a, c, t, g, unknown or other
  misc_feature (468)..(468): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctcggggcccccagggcagagggtcaccatctcgtgcactggaagtagctccaacagtcggggcacgttangatgtacactgtaccaacacttccaggaacacgccccaaagtcatcatttangacaaacatcgaacgccgccctcgacggggtcccctgacccgtattcccncccggcctacccgaagtccgtgaccanactcacnccctcccgtgcccatccacgtcgggacctccgaggctggagacgtgacggctgaacttacttacncgtacctagtacgtatacgacgtagttacggaaccttaaagtaacctacttccggttaacgttacggtaacgtacgggggtaaccaacgggttcccgaacccgtttccgg

SEQ ID NO: 358638 - DNA, 606 bp, Homo sapiens
  misc_feature: GZ8MTXP02I7455.9.34.D01.1.454.CMB.2.raw
  modified_base (233)..(233): a, c, t, g, unknown or other
  misc_feature (233)..(233): n is a, c, g, or t
  modified_base (321)..(321): a, c, t, g, unknown or other
  misc_feature (321)..(321): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccaagaacatactgtctctgcaactcaaataacctgagaggcgaggacacggcctatttattcngtgcgaaggagcatagtggaactacgtatttcgactcccncgcngtcgactactttgacttacggcgggggacccgggtaacccgtcggtccgtcccgtctccgtcacgccctaccgaaccgaacgggcccacgttcccggttcccttcccccgtcggtcccctacccctccctacccgaaacgcgaccacccgtcgtcgggggaccacgacggccggcccgtgggcctcggccgtcggtacaacggtacctaaccgtccgaacgtacgtactcgacgtggacgg

SEQ ID NO: 358639 - DNA, 590 bp, Homo sapiens
  misc_feature: GZ8MTXP02GOFGA.9.34.D01.1.454.CMB.2.raw
  modified_base (232)..(232): a, c, t, g, unknown or other
  misc_feature (232)..(232): n is a, c, g, or t
  modified_base (318)..(318): a, c, t, g, unknown or other
  misc_feature (318)..(318): n is a, c, g, or t
  modified_base (371)..(371): a, c, t, g, unknown or other
  misc_feature (371)..(371): n is a, c, g, or t
  modified_base (459)..(459): a, c, t, g, unknown or other
  misc_feature (459)..(459): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagagcgaggacacggcctatttatttcngtgacggaaggaggcatagtagggaacgtacgtattttcgacttccctccgcngtcactactttgacttacggcgggggacccgggacctggtccgccgtctcctcacgccctccaccgaacggccagtccgtcctcccgngccaccctcaccaagcgcctacctcggtcggggacacgacggccggcccgtggggcctcggccgttacggtaccgaacggtacccttaacgttacccgaacggtaccgtacgtaccgaacgttggaccggg

SEQ ID NO: 358640 - DNA, 560 bp, Homo sapiens
  misc_feature: GZ8MTXP02H11BI.9.34.D01.1.454.CMB.2.raw
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
  modified_base (360)..(360): a, c, t, g, unknown or other
  misc_feature (360)..(360): n is a, c, g, or t
  modified_base (380)..(380): a, c, t, g, unknown or other
  misc_feature (380)..(380): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggaggactggagtgggtcgcaggcatcgctggtggcggtcatgacacattctacgcaaactccgtgagggccncttcatcatctccaganacaatcccagaacatactgtctctgcaactcaaataacctgagaggcgaggacacggccatttatttctgtgcgaaggaggcatagtggaagtacgtattttcgatccctcgcngtcgactactttgattacgngggggcccgggaaccctggtcgccgtctcctcagccctcaccaacgggccagtccgtcttccccctggccacccctcctcccaagacgccaccgtctgggggcaacgcgccggcccgttgggctcgccctggtcaaacggtactaaccgtttcgaacgtacgtatcctacgtacgacggg

SEQ ID NO: 358641 - DNA, 589 bp, Homo sapiens
  misc_feature: GZ8MTXP02FWLDU.9.34.D01.1.454.CMB.2.raw
  modified_base (363)..(363): a, c, t, g, unknown or other
  misc_feature (363)..(363): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaaataacctgagaggcgaggacacggccatttatttctgtgcgaaggaggcatatgggaagtacgattttcgatccctcgcngtcgactactttgattacgtgggggcccggggaaccctggtcgccgtctcctcacgcctccaccaacgggcccagtccggtccttcccccgtggcccacccctccctacccaaacgcgccaccgtcgtcgggggccacgcggccggcccgtggggccttcggccgttcgggtaccaacggtacctaaccgttcccgaacggtaccgtactaccaccgtggaacggg

SEQ ID NO: 358642 - DNA, 526 bp, Homo sapiens
  misc_feature: GZ8MTXP02I6SV3.9.34.D01.1.454.CMB.2.raw
  modified_base (429)..(429): a, c, t, g, unknown or other
  misc_feature (429)..(429): n is a, c, g, or t
  modified_base (459)..(459): a, c, t, g, unknown or other
  misc_feature (459)..(459): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgcctcagtgtctggggccccagggcagagggtcaccatctcgtgcactggaagtagctccaaacagtcggggcacgttatgatgtacactggtaccaacaacttccaggaacacgaccccaaagtcatcatttatagacaaacatagaagccgccctcgacgggtcccctagccgtattcctccggctccaagtctcggacacatcacgccctccctcgccatcacgtcggctccgaggctgagntggacgctgactatactagccagtcgtacngacagtacgacctaaagtacactcgtaacgttacggaacgtcgggaccgtaacggtccgacgtccgg

SEQ ID NO: 358643 - DNA, 555 bp, Homo sapiens
  misc_feature: GZ8MTXP02I6YPC.9.34.D01.1.454.CMB.2.raw
  modified_base (319)..(319): a, c, t, g, unknown or other
  misc_feature (319)..(319): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctcggggccccagggcagaggtcaccatctcgtgcactggaagtagctccaacatcggggcacgttatgatgtacactaggtaccaacacttccaggaaccacgaccccaaagtcatcatttangacaacatgaacgcgcctcgaggggtccctgccgtattccgtccggtctaccaagtctaggcacactcgactccctccctggccctatccgaacgtcgggcctaccgaggtcctggaggaatgggacgtctagacttagtactcgaccgtagtacgtaatcgacaggtacggactaaacgtaacagttccgtcgttaccggacgttacggggaacctaggtacctaccggttccgg

SEQ ID NO: 358644 - DNA, 518 bp, Homo sapiens
  misc_feature: GZ8MTXP02JDZJD.9.34.D01.1.454.CMB.2.raw
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
  modified_base (505)..(505): a, c, t, g, unknown or other
  misc_feature (505)..(505): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaacctcaataacctgagaggcagggacacggccatttattctgtgtcgaaggaggcatatggaagtacgattttcgatcctcgcagtcgactacttggtactgggccgggacctggtcgcgtctctacncncncacacgcnctcgtctccncgcgccnccncacgacncncncg

SEQ ID NO: 358645 - DNA, 589 bp, Homo sapiens
  misc_feature: GZ8MTXP02F042F.9.34.D01.1.454.CMB.2.raw
  modified_base (232)..(232): a, c, t, g, unknown or other
  misc_feature (232)..(232): n is a, c, g, or t
  modified_base (364)..(364): a, c, t, g, unknown or other
  misc_feature (364)..(364): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggcctatttattctgtgcgaaggagcatagtggaagtacgtatttcgactccctccgacngtcgactactttgattacgcggggacccggggaaccctggtcgcccgtctccctcacgccctccaccgaacgggcccatccggtcccttccccgtcggtaccctcctaccaagaccgccaccgtcgtcgggggcacgacgccggcccgtgggcctcgccgttacggtaccgaaacggtcctaaccgttccgacggtaccgtaactccgtaacgtggacggccggg

SEQ ID NO: 358646 - DNA, 573 bp, Homo sapiens
  misc_feature: GZ8MTXP02HWXNM.9.34.D01.1.454.CMB.2.raw
  modified_base (233)..(233): a, c, t, g, unknown or other
  misc_feature (233)..(233): n is a, c, g, or t
  modified_base (396)..(396): a, c, t, g, unknown or other
  misc_feature (396)..(396): n is a, c, g, or t
  modified_base (563)..(563): a, c, t, g, unknown or other
  misc_feature (563)..(563): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctgggtggcggtcatgacacattctacgcaaactccgtgaggggccncttcatcatctccagagacaattccccaagaacatactgtctctgcaactcaaataacctgagaggcgaggacacggcctatttatttctgtgacggaaggaggcatagtagggaacgtacgtattttcgacttccctccgctgtcgactactttgattacgngggggacccgggacctggcgccgtctcctcacgccctccaaccgaacgggcccagtccggtccttcccccgtggccacccctcctacccaagcgccaccgtcgcgggggcacgcggccgcccgtgggctcgccgtcggtacaaggacctaacgttccaagtacgtanccactgacgg

SEQ ID NO: 358647 - DNA, 576 bp, Homo sapiens
  misc_feature: GZ8MTXP02G8EC8.9.34.D01.1.454.CMB.2.raw
  modified_base (232)..(232): a, c, t, g, unknown or other
  misc_feature (232)..(232): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaaataacctgagaggcgaggacacggccatttattctgtgcgaaggagcatagtgggaagtacgattttcgatccctcgcagtcactactttgacttacgtgggggacccggggaaccctgggtccgccgtctcctcacgccctccacccgaacgggccccatccggtccttcccccgtcggccaccccgtcctacccaagacgcacctcgtacgggggcacgacgccggcccgtggggcctcgccgttcggccaaggacctaacgttccaacgtacgtatccacgtacggacgg

SEQ ID NO: 358648 - DNA, 644 bp, Homo sapiens
  misc_feature: GZ8MTXP02G4J5K.9.34.D01.1.454.CMB.2.raw
  modified_base (337)..(337): a, c, t, g, unknown or other
  misc_feature (337)..(337): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgccgccctcagtgtcgtcgggccccagggcagaggtcaccatctcgtgacacgtggaagtacgcctaccaacgagtcggggactacgttatgatagtacacgtacggaaccaacaccgtaccaggaaccacgacccccaaagtcatctaattanagaacaacatacgaacgccgtaccctacggacggggtccctacgaccgtacttccgtcccggtcctaccgaacgtcgtacggacactatccgacgccctccctggaccctatccgacgtcggcctaccgaggcgtaggagtagtcgggaaggtctacggtaacttaacgtttacgacgtaccgtagtaccgttaagtacggaaaccgtaggttaccgggaaccttaaaacggtaacctacgttccgtaaccgtttacgggaaaccgtacggggtaaaccgtaacgggtccccctaaccggttaccgg

SEQ ID NO: 358649 - DNA, 608 bp, Homo sapiens
  misc_feature: GZ8MTXP02HRPV6.9.34.D01.1.454.CMB.2.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggaatgggtcgcaggcatcgctggtggcggtcatgacacattctacgcaaactccgtgagggccgcttcatcatctccagagacaattcccaagaacatactgtcctctgacaaactcaaataaacctgaaggaggacgaagggaaccacggaccctaagttttaatttcgtgtgacggaaaggaggcaatagtagggaaacgtagtattttcgaactccctacgcagtcgaactactttgacttaacgtcgggggacccggggaaccctgggtccgccgtcctccctcacgccctaccaaccgaaacgggcccagtccggtcccttcccccgtggccctacccctcctaccgaagacgccaaccttcggacgggggacacgacggccggcccgtgggctcgcctcgacaaggactaacgtccagtacgtactcactgacgg

SEQ ID NO: 358650 - DNA, 550 bp, Homo sapiens
  misc_feature: GZ8MTXP02JRNT9.9.34.D01.1.454.CMB.2.raw
  modified_base (324)..(324): a, c, t, g, unknown or other
  misc_feature (324)..(324): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcacgtggaagtagctaccaacgagtcggggctacgttatgatgtacactaggtaaccaacacttccaggaacacgaccccaaagtcatctattanagacaacatacgaacgccgccctacggacgggtcccagaccgtattccgccggcctaccgaacgtctcggaccacgactcacgtccctcccgtgccaatcacgtcggcctccgagctaggagactggaggtctagacgttactactcgcctagtcgtactggactacggtcgacctaagtactactcgtaacgtacggaacgtcgggacctacggtccgacgtcgg

SEQ ID NO: 358651 - DNA, 586 bp, Homo sapiens
  misc_feature: GZ8MTXP02H0XHE.9.34.D01.1.454.CMB.2.raw
  modified_base (464)..(464): a, c, t, g, unknown or other
  misc_feature (464)..(464): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccgcttcatcatctccagagacaattcccagaacatactgtctctgcaactcaataacctgagaggcgaggacacggcctatttatttctgtgcgaaggaggcatagtgggaagtacgtattttcgacttccctccgcagtcgaactactttgattacgtgggggcccgggaacccgtggccgcccgtcgtccctcgacgccctccaccgaacgggcccatccggtccttcccccncggtcccacccctccctccaaacgacgccaccctcgtcgggggaccacgacgccggcccgtgggcctcgccgtcggtaccaaggacctaaccgttccgaacgacgtactcctacgtacgcgg

SEQ ID NO: 358652 - DNA, 584 bp, Homo sapiens
  misc_feature: GZ8MTXP02JO3IW.9.34.D01.1.454.CMB.2.raw
  modified_base (230)..(230): a, c, t, g, unknown or other
  misc_feature (230)..(230): n is a, c, g, or t
  modified_base (325)..(325): a, c, t, g, unknown or other
  misc_feature (325)..(325): n is a, c, g, or t
  modified_base (358)..(358): a, c, t, g, unknown or other
  misc_feature (358)..(358): n is a, c, g, or t
  modified_base (378)..(378): a, c, t, g, unknown or other
  misc_feature (378)..(378): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccncttcatcatctccagagacaattcccagaacatactgtctctgcaactcaataacctgagaggcgaggacacggccatttattctgtgcgaaggnggcatagtggaagtacgatttcgatccctcgcngtcgactactttgattacgnggggcccgggaaccgtggtcgccgtctcctcacgccctaccacccgaacgggcccacgttccggtcccttcccccgtcggccctacccctccgtacccgaacgacgcctaccgtcgtcgggggccacgacggccggcccgtcgggctcggcccgtcggtaccgaacggtacctaacgttccgacgtacgtactcgacgtcgacggg

SEQ ID NO: 358653 - DNA, 563 bp, Homo sapiens
  misc_feature: GZ8MTXP02HNWOD.9.34.D01.1.454.CMB.2.raw
  modified_base (233)..(233): a, c, t, g, unknown or other
  misc_feature (233)..(233): n is a, c, g, or t
  modified_base (331)..(331): a, c, t, g, unknown or other
  misc_feature (331)..(331): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactgggagtgggtcgcaggcatcgctggtggcggtcatgacacattctacgcaaactccgtgaggggccnttcatcatctccagagacaattcccagaacatactgtctctgacaactcaataacctgagaggcgaggacacggcctatttattctgtgacggaaggngcatagtgggaagtacgattttcgattccctccgcagtcgactctttgattacgtgggggcccgggaacctggtccgccgtctcctacgacgccctccaccgacgggccccagtcccggtccttccccgtcgcctacccctccgtacccaagcgaccaccgtcgcggggcacgcggtccggccgtgggctcgcctaggcaacggctaacgtcgacgtacgtatcactgacgg

SEQ ID NO: 358654 - DNA, 547 bp, Homo sapiens
  misc_feature: GZ8MTXP02G7VH7.9.34.D01.1.454.CMB.2.raw
  modified_base (364)..(364): a, c, t, g, unknown or other
  misc_feature (364)..(364): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccagtttatttctgtgcgaaggaggcatatgggaagtacgattttcgattccctccgcngtcgacactttgattacgtggggcccgggaaccctggtcgccgtctcctcagccctcaccaagggtccccatccggtcttccccctggcccaccctcctcccaagcgcaccgtcgtgggggccacagccggcccctgggcctgccctggtccaaggctaacttccagacctatcgactgacgg

SEQ ID NO: 358655 - DNA, 542 bp, Homo sapiens
  misc_feature: GZ8MTXP02HJCB8.9.34.D01.1.454.CMB.2.raw
  modified_base (325)..(325): a, c, t, g, unknown or other
  misc_feature (325)..(325): n is a, c, g, or t
  modified_base (469)..(469): a, c, t, g, unknown or other
  misc_feature (469)..(469): n is a, c, g, or t
  modified_base (482)..(482): a, c, t, g, unknown or other
  misc_feature (482)..(482): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagcccgccctcagtgtctcggggccccagggcaggagggtcaccatctcgtgcactggaagtagctccaacagtcggggcacgttatgatgtacactggtaaccaacaacttaccaggaacacgaccccaaagtcatcatttanagaacaacatacgaacgccggacccctcgacggggtccctagccgtattcgtcccggctccaacgtctcggccacactcacgtccctacccgtggcccactcacgtcggcctccgaggctggagatggaggctagactattacncgcgtagtcgtangacacgtgacctaagtacatcgtcgttacggaacgtacggacctacggtctacccgtcgg

SEQ ID NO: 358656 - DNA, 583 bp, Homo sapiens
  misc_feature: GZ8MTXP02FUVOE.9.34.D01.1.454.CMB.2.raw
  modified_base (270)..(270): a, c, t, g, unknown or other
  misc_feature (270)..(270): n is a, c, g, or t
  modified_base (330)..(330): a, c, t, g, unknown or other
  misc_feature (330)..(330): n is a, c, g, or t
  modified_base (537)..(537): a, c, t, g, unknown or other
  misc_feature (537)..(537): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtcgtcggggccccagggcaggagggtcaccatctcgtgcactggaagtagctaccaaacagtcggggcacgttangatgtacactaggtaccaacaacttccaaggaaccacgacccccaaagtcatcaatttanagacaacatacgacgccgcctcgacgggtcccagccgacttccgccgctccgaagtctggcacactccgacgtccctcccgtagccctatccaccgtcgggcctccggaggtcgtagggaacggagttgggaacggctacgtaacttacgttacgtcgacccgtagttaccgtagtacgaccgtaggtcggaaccttaaacgtaacncgttcgtaacgttacggaacgtcggaacctaacgtccgacgtccgg

SEQ ID NO: 358657 - DNA, 446 bp, Homo sapiens
  misc_feature: GZ8MTXP02IWUR7.9.34.D01.1.454.CMB.2.raw
  modified_base (362)..(362): a, c, t, g, unknown or other
  misc_feature (362)..(362): n is a, c, g, or t
  modified_base (436)..(436): a, c, t, g, unknown or other
  misc_feature (436)..(436): n is a, c, g, or t
  modified_base (438)..(446): a, c, t, g, unknown or other
  misc_feature (438)..(446): n is a, c, g, or t
tcagtgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagccccaaagtcatcatttatgacaacatgaagcggccctcgaggggtccctgaccgattctccggctccaagtctggcacatcagcctccctggccatcactggctccagctgagatgagctgactattactgccagtcgtatgacagtggcctaaagtaacatcgtcttcgaactgggacaaggtcaccgtcngggtcagcccaagccaaacccactgtcactctgttcccaccctctcagactatcatgagcgggctgcagcgcanannnnnnnnn

SEQ ID NO: 358658 - DNA, 599 bp, Homo sapiens
  misc_feature: GZ8MTXP02FQ2EA.9.34.D01.1.454.CMB.2.raw
  modified_base (232)..(232): a, c, t, g, unknown or other
  misc_feature (232)..(232): n is a, c, g, or t
  modified_base (361)..(361): a, c, t, g, unknown or other
  misc_feature (361)..(361): n is a, c, g, or t
  modified_base (382)..(382): a, c, t, g, unknown or other
  misc_feature (382)..(382): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagagcgaggacacggccatttattctgtgcgaaggagcatagtgggaatacgattttcgactccctccgcngtcgactacgtttgattacgngggggcccgggaaccctggtccgcccgtctcccgtcacgccctaccacccgaacggggccccagtccggttccttccccctgggccctacccctcctacccaacggtacgcccaccgtcgtcgggggaccacgacggccggccccgtggggcctcggacccgttcgggtaccaaacgggtacctaacgttcccaagtaccgtatccgaactcggagg

SEQ ID NO: 358659 - DNA, 588 bp, Homo sapiens
  misc_feature: GZ8MTXP02HNMYQ.9.34.D01.1.454.CMB.2.raw
  modified_base (233)..(233): a, c, t, g, unknown or other
  misc_feature (233)..(233): n is a, c, g, or t
  modified_base (378)..(378): a, c, t, g, unknown or other
  misc_feature (378)..(378): n is a, c, g, or t
  modified_base (479)..(479): a, c, t, g, unknown or other
  misc_feature (479)..(479): n is a, c, g, or t
  modified_base (499)..(499): a, c, t, g, unknown or other
  misc_feature (499)..(499): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccaagaacatactgtctctgcaactcaaataacctgagaggcgaggaccacggcctattttattctgtgacggaaggaggcaagtagtagggaaagttacgtattttcgacttccctccgntgtcgactacgtttgaagttacgcgggggcccgggtaacccgtggtccgtcccgtctccgtcacgccctccaccgacgggcccagtccggtccttccccgngccaccctcctaccaacgcncaccgtcggcggggcacgcgccggccgtggcctcgccgtcgaccgaacggtaccttaaccgtcgaacgtacgtactcgaacgtggacgg

SEQ ID NO: 358660 - DNA, 584 bp, Homo sapiens
  misc_feature: GZ8MTXP02HQNP9.9.34.D01.1.454.CMB.2.raw
  modified_base (359)..(359): a, c, t, g, unknown or other
  misc_feature (359)..(359): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccgcttcatcatctcagagacaattcccagaacatactgtctctgcaactcaataacctgagaggcgaggacacggccatttattctgtgacgaaggagcatagtgggaatacgattttcgatccctcgcncgtcgactacgtttgattacggtgggggacccggggtaaccctggtccgccgttcctcctccacgccctccaacccgaacgggcccagtccggttccttcccccgtggccacccctcctccaacgacgacaccgtcgtcgggggcaacgcgccggcccgttggggcctcggccgttcgggtacaaacggccttaacgttcgaagacgttatccgaactggacggg

SEQ ID NO: 358661 - DNA, 568 bp, Homo sapiens
  misc_feature: GZ8MTXP02FO2DD.9.34.D01.1.454.CMB.2.raw
  modified_base (322)..(322): a, c, t, g, unknown or other
  misc_feature (322)..(322): n is a, c, g, or t
  modified_base (467)..(467): a, c, t, g, unknown or other
  misc_feature (467)..(467): n is a, c, g, or t
  modified_base (510)..(510): a, c, t, g, unknown or other
  misc_feature (510)..(510): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcaggagggtcaccatctcgtgcactggaagtagctaccaacagtcggggcacgttatgatgtacactggtaaccaacaactccaagaacacgaccccaaagtcatcatttangacaaacatcgaagccggccctcgacggggtcccctgacccgtattcctccggctacccaagtcgtcggacacactcacgccctacccgtgccctaatccgacgtcgggcctaccgaggctagagatgagctagaactattacgngacctagtacgtatacgactaggtcggtaacctaaagtaaacncgttaccgtaacgttacggaaaccgtagggaaccgtaacggtaccgaaccggttccgg

SEQ ID NO: 358662 - DNA, 605 bp, Homo sapiens
  misc_feature: GZ8MTXP02G4I2U.9.34.D01.1.454.CMB.2.raw
  modified_base (264)..(264): a, c, t, g, unknown or other
  misc_feature (264)..(264): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacntactgtctctgcaactcaataacctgagagcgaggacacggccatttattctgtgcgaaggaggcatagtgggaacgtacgtattttcgatcccctcgcagtcgactactttgattacgtgggggacccgggtaacccgtggtccgccgtctccctcacgccctccaccgaacgggcccacgtccggtccctttcccccgtcggccctaccccgtccctacccaacgacgccacctccgtcgggggccaacgcggccggcccgtcggggctcggccgtcgggtaccgaacggtacctaaccgttacgaaccccccgaggttactaccacgttcggaacggg

SEQ ID NO: 358663 - DNA, 716 bp, Homo sapiens
  misc_feature: GZ8MTXP02F3IYS.9.34.D01.1.454.CMB.2.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgcccgccctcagtgtcgtcggggccccagggcaggagggtcaccatctcgtgcacgtggaagtacgcctaccaacacgtcggggactacgttatgatgtacactacggtaaccaactaacctaccgaaggaaccaccgacccccaaagtccatactaattttacacgaacaaactatacgaacgccggaccccgtacggaccggggttaccccctacggacccgtacgttcccgtacccgggtccttacccgtaaacggttccgtacgggaccctaacctacttacccaccggtcccccttaccccgtccgggaccctaacgttacccgaaccgttaccgggggccccttacccggaacggggtacccgttacggggaaacgggtacgttaggggaacggtacccgttacggtaaaccttacgtttaccgtacggtaccgtacgttaccgtagttacggacgtacggtacgtaacctaagtaactacgttacgtaacgttacggaacgtacggactacggtccgaccgttcgg

SEQ ID NO: 358664 - DNA, 560 bp, Homo sapiens
  misc_feature: GZ8MTXP02IVGMP.9.34.D01.1.454.CMB.2.raw
  modified_base (364)..(364): a, c, t, g, unknown or other
  misc_feature (364)..(364): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatagtgggaagtacgattttcgatccctccgcngtcgacactttgattacgtgggggcccgggaaccgtggtcgccgtcctcctcagccctcaccgaacgggcccatccggtccttccccctggccctacccctcctcccaacgacgccacctcgtcgggggcacgacgccggccctgggctcgcctcggtcaacggactaacgttccacgtacgtactcacgtgacgg

SEQ ID NO: 358665 - DNA, 566 bp, Homo sapiens
  misc_feature: GZ8MTXP02GAGNZ.9.34.D01.1.454.CMB.2.raw
  modified_base (233)..(233): a, c, t, g, unknown or other
  misc_feature (233)..(233): n is a, c, g, or t
  modified_base (369)..(369): a, c, t, g, unknown or other
  misc_feature (369)..(369): n is a, c, g, or t
  modified_base (555)..(555): a, c, t, g, unknown or other
  misc_feature (555)..(555): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccagaacatactgtctctgcaactcaaataacctgagaggcgaggacacggcctatttattctgtgcgaaggaggcatagtgggaacgtacgtattttcgactccctccgcngtcgactactttgattacgtcgggggacccgggtaaccctggtccgccgtctcctcacgccctccaccgaacgggcccacgtccggtcccttcccccgtcggccctaccccgtcctaccaaacgcgccaccgtcgtcggggcacgcgccgcccgtgggctcgcgtcgacaggactcgtcagacgtntcacgtgacgg

SEQ ID NO: 358666 - DNA, 547 bp, Homo sapiens
  misc_feature: GZ8MTXP02HYJIB.9.34.D01.1.454.CMB.2.raw
  modified_base (314)..(314): a, c, t, g, unknown or other
  misc_feature (314)..(314): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctgggccccagggcagaggtcaccatctcgtgcactggaagtgctccaacagtcggggcacgttatgatgtacactggtaccaacactcaggaacacgaccccaaagtcatcatttangaacaacatacgaagccgccctcgacggggtccctgccgtattccgtccgctaccaagtctcggcacactcacgccctccctggtccactccgacgtcgggcctcgaggctaggaggatgggacgtcgtagtacttattacgtcgacctagtacgtatcgactacgtacggtacctaaagtacacttcgtaacgttacggaacgtcggaccgtaacggtccgtaaccggtccg

SEQ ID NO: 358667 - DNA, 759 bp, Homo sapiens
  misc_feature: GZ8MTXP02H24UQ.9.34.D01.1.454.CMB.2.raw
  modified_base (235)..(235): a, c, t, g, unknown or other
  misc_feature (235)..(235): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccgaggggagggactgggagtgggtcacaggcatcgctggtgggcggtcatgacacattctacgcaaactccgtggaggggccncttcatcatctcagagacaatcccaagaacatactgtctctcgacaaactcaaataacctgaagaggcgaaggacacggcctaattttattcgtgtgacggaaaggaggacaatagtaggggaaagttacgtaatttttccgaacttccccctccggactagttaccgaacttacctttttagaacgttttaccgggacggggggacccccgggggtaaaccccttcggggcccggtcccggttcccttccccgttccgaaccggtcccccttaccccgaaacccggtaaaccgggggccccctaaacgttcccgggtttcccctttaccccccgtcggggaccctaacccccttcccgtaacccgaaaggaaccgcccgaacccgtcgggttcgggggacccaaaccggacggtcccgggcccggttacggggccctcgggaccccgttgggtaacccgaaaagggtacccttaaccgttacccgaaacggtaccgtaactccggaaccttacggaaccgggg

SEQ ID NO: 358668 - DNA, 654 bp, Homo sapiens
  misc_feature: GZ8MTXP02GM518.9.34.D01.1.454.CMB.2.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgccgccctcagtgtcgtcgggccccagggcaggagggtcaccatctcgtgcacgtggaagtagctaccaacagtcggggctacgttatgatgtacactacggtaaccaacaacttccgaaggaacacgaccccaagtcatcatttatagaacaaactatacgaacgccgacctacgacggggtcccctacgaccgtacttccgtacccggtacctacccgtaaacgtccgtacgggaccacctacttacccgaaccgtcccctcccgttcggaccctaacgtccgtaccgttcgggcccttacccggaggccttagggaggtacttagggacgtactaggtacttaagttacgcgacccgtagttcgtactacgaaaccgtagtacggtaaccttaaacgtaacctacgttaccgtaaccgtttaccggaacgttacggggaacctaacggtacccgtaaccggttcccgg

SEQ ID NO: 358669 - DNA, 481 bp, Homo sapiens
  misc_feature: GZ8MTXP02I77GF.9.34.D01.1.454.CMB.2.raw
  modified_base (460)..(481): a, c, t, g, unknown or other
  misc_feature (460)..(481): n is a, c, g, or t
tcagtgatacgtctcacgaccggtgctcgatttagatcgtctgtgttgggtttgggggctgttcctggaagttgttggtaccagtgtcaccatctcgtgcactggaagtagctccaacatcggggcacgttatgatgtacactggtaccaacaacttccaggaacagcccccaaagtcatcatttatgacaacatgaagcggccctcaggggtcccctgaccgattctccggctccaagtctggcacatcagcctccctggccatcactgggctccaggctgaggatgaggctgactatactgccagtcgtatgacagtggcctaaagtacatcgtctcggactgggaccaaggtcaccgtctggggtcacgcccaaggcccaacccgactcgtccactcctcgtccccaccctcctcacgacgtactcactgagccgggctggacacggcgacagtagnnnnnnnnnnnnnnnnnnnnnn

SEQ ID NO: 358670 - DNA, 579 bp, Homo sapiens
  misc_feature: GZ8MTXP02GTAOD.9.34.D01.1.454.CMB.2.raw
  modified_base (445)..(445): a, c, t, g, unknown or other
  misc_feature (445)..(445): n is a, c, g, or t
tcagtgatacgtctcacgaccggtgctcgatttagatcgtctgtgttgggtttgggctgacctggctttttctcgtggctgttttaaaaaggtgtccagtgtgaggttcaactgttggagtctggggggaggcttggtccagcctggggagtccctgcgactctcctgtgtggcctctggattcacctttgagacctatgccttgacctgggtccgccaggctccagggggagggactggagtgggtcgcaggcatcgctggtggcggtcatgacacattctacgcaaactccgtgaggggccgcttcatcatctccagagacaatcccaagaacatactgtctctgcaacctcaaataacctgagaggcgaggacacggcctatttatttcgtgtgacgaaaggaggcagtagtagggaagtacgtatttcgacttccctccgnacgtcacttacgtttcggttacggtcgggggacccgggaccgtcggtccgcccgtctcccgtcacgcctccgaccgacggcccacgtcccgttcctccccgtcgccctaccctcccaccaagcgccgacctcgg

SEQ ID NO: 358671 - DNA, 570 bp, Homo sapiens
  misc_feature: GZ8MTXP02IXNNO.9.34.D01.1.454.CMB.2.raw
  modified_base (366)..(366): a, c, t, g, unknown or other
  misc_feature (366)..(366): n is a, c, g, or t
  modified_base (457)..(457): a, c, t, g, unknown or other
  misc_feature (457)..(457): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattccccagaacatactgtctctgcaactcaaataacctgagaggcgaggacacggccatttatttctgtgcgaaggaggcatagtgggaagtacgattttcgatccctccgcngtcgactactttgattacgtgggggcccgggaaccctggtcgccgtctcctcacgccctccaccaacgggcccatccggtccttcccccgnggccacccctcctcccaagcgccacctcgtcgggggcacgacggccggccctggggcctcggccgtcgggtacaacggaccttaaccgttccagtaccgtatcacgtcgacgg

SEQ ID NO: 358672 - DNA, 605 bp, Homo sapiens
  misc_feature: GZ8MTXP02HWZ0H.9.34.D01.1.454.CMB.2.raw
  modified_base (334)..(335): a, c, t, g, unknown or other
  misc_feature (334)..(335): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtcgtcgtcggggccccagggcagaggtcaccatctcgtgcacgtggaagtagctaccaacgagtcggggcacggttatggatgtaaccactacggtaaccaacaacttccaaggaaccacgaccccaaagtcatctattannacaacatacgaagccgccctgacggggtccctagcccgtacttccgtacccggtccttaccaacgtcctcggaccaacactccacgccctacccgtcgacctatccgactcgggacctccgaggctaggaagatcggaggtctaggaacttagtaccgtcgacccgtagttaccgtaagtcgacgtacgtacggaccttaaaacgtaactacgttaccgttaacgttacggaacgttcggggaaacctacggtcccgtaaccggttccgg

SEQ ID NO: 358673 - DNA, 587 bp, Homo sapiens
  misc_feature: GZ8MTXP02ICQ54.9.34.D01.1.454.CMB.2.raw
  modified_base (336)..(336): a, c, t, g, unknown or other
  misc_feature (336)..(336): n is a, c, g, or t
  modified_base (576)..(576): a, c, t, g, unknown or other
  misc_feature (576)..(576): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccaagaacatactgtctctgcaactcaataacctgagaggcgaggacacggccatttatttctgtgcgaaggaggcatagngggaagtacgtattttcgactccctccgctagtccgactactttgaattacgtcgggggcccggggaacccgtgggtccgccgtcctcctcacgccctccgacccaaacgggccccacgttccgggttccctttccccccgtcggcccaccccctcccgtacccaaacgacgccacccgtcgtgggggccacgacgccggcccgtgggctcgcctggcaaggactaacgttcagacgtanccacgtgacgg

SEQ ID NO: 358674 - DNA, 673 bp, Homo sapiens
  misc_feature: GZ8MTXP02F4PH0.9.34.D01.1.454.CMB.2.raw
  modified_base (319)..(319): a, c, t, g, unknown or other
  misc_feature (319)..(319): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctgggtggcggtcatgacacattctacgcaaactccgtgaggggccgcttcatcatctccagagacaatcccagaacatactgtctctgcaactcaaataacctgagaggcgaggacacggctatttattcngtgacgaaggagcatagtgggaacgtacgtattttcgacttcccccgtccgactgtaccgaacttacgttttgaactttaccgggtacggggggaccccgggggtaaacccgttggggtcccgtcccggtccgttcccgtaccgaacgcccctacccaacccgtaaaccggggacccctacgttcccgggttccccttcccccgtcgggaccctaccccctccctacccgaaacgacgccaccgtcggtcgggggaccaaccgcggcccggcccgtcgggtcgtcggaccgtcgggtaccaacggtaccttaaccgttcccgaacggtacgtactaccgaacgttcggaacggg

SEQ ID NO: 358675 - DNA, 655 bp, Homo sapiens
  misc_feature: GZ8MTXP02H3TDE.9.34.D01.1.454.CMB.2.raw
  modified_base (249)..(249): a, c, t, g, unknown or other
  misc_feature (249)..(249): n is a, c, g, or t
  modified_base (318)..(318): a, c, t, g, unknown or other
  misc_feature (318)..(318): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagaggtcaccatctcgtgcactggaagtagctaccaanagtcggggcacgttatgatgtacactggtaccaacaactcaggaaccagaccccaaagtcatctattangaacaacatcgaagccgacctcgacggggtccctgaccgtattccgccggtctacccaagtcctcgggacctacactaccacgcccctcccgtacggccctaatcccaacgttcggggcctacccggaggtaccgttacgggaaggagttacgggacgggtacttacggaaactttaacgttacgtcggtacccgtaaggttacccgttagtacggtaaccgtacggttacgggtaacccttaaaacggtaaacctaacgtttccgttaaccgtttacccgggaaaacgtttccgggggaaacccgtaaacgggtaccgtaaccccgggtttcccgg

SEQ ID NO: 358676 - DNA, 582 bp, Homo sapiens
  misc_feature: GZ8MTXP02FV4YI.9.34.D01.1.454.CMB.2.raw
  modified_base (302)..(302): a, c, t, g, unknown or other
  misc_feature (302)..(302): n is a, c, g, or t
  modified_base (551)..(551): a, c, t, g, unknown or other
  misc_feature (551)..(551): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgagggggagggactggagtgggtcgcaggcatcgctggtggcggtcatgacacattctacgcaaactccgtgagggccncttcatcatctccagagacaattccccagaacatactgtctctgcaacctcaaataacctgagaggcgaggacacggcctatttattctgtgacgaaaggagcaatagtagggaagtacgtatttacgactccctcgctacgtcgactactttgaacgtttacgtacgggggcccggggtaacctcgggtccgtccgtcctccctcacgccctaccaccgaaacggcccacgtccggtccttcccccgnggcccacccctcctaccaacgacgctacccg

SEQ ID NO: 358677 - DNA, 512 bp, Homo sapiens
  misc_feature: GZ8MTXP02J1IO4.9.34.D01.1.454.CMB.2.raw
  modified_base (395)..(395): a, c, t, g, unknown or other
  misc_feature (395)..(395): n is a, c, g, or t
  modified_base (439)..(439): a, c, t, g, unknown or other
  misc_feature (439)..(439): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacacgacccccaaagtcatcattatgacaacatacgaagcgccctcgacggggtccctgccgattccgtccggctccaagtctggcacatcagccctcccngccatcacgtcggctccgaggctggagatgagctgactagtacngccagtcgtatgacacgtcggacctaagtaactatcgtcgttacggaactacggtaccaacggtcaccgtccg

SEQ ID NO: 358678 - DNA, 745 bp, Homo sapiens
  misc_feature: GZ8MTXP02JGQRP.9.34.D01.1.454.CMB.2.raw
  modified_base (330)..(330): a, c, t, g, unknown or other
  misc_feature (330)..(330): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgaggggaggactgggaggtgggtcgcaggcatcggcgtgggtggcggtcagtgacactattcacgacaaacgtccgtaggacgggcctcttcatcatcctaccaganaactaacttcccaagtaaccattactcgtcctctacgacctaaacctcaaaacttaccgaggaacggacgggacgacgggtaccacgggtaccttaattttacgttcgtaggtagaacggaagggagacgtaagtaaggtaggggtaaacgttaccggttacttttaccgaccttccccgtccgtacgtacgtaccgtaacttacgtttagtacggtttaccgggaccgggggtaccccgggtaacccgttcgggtaccccgtcccggttcccttacccgacccgtaccgtaccccgaccccgaaacccggtaaacccgggtccccttaccggttccccggttcccccgttacccccgtcggaccccctacccccgtacccgtaacccgaacggtacccgcccgttaaccccggg

SEQ ID NO: 358679 - DNA, 601 bp, Homo sapiens
  misc_feature: GZ8MTXP02GQBTH.9.34.D01.1.454.CMB.2.raw
  modified_base (233)..(233): a, c, t, g, unknown or other
  misc_feature (233)..(233): n is a, c, g, or t
  modified_base (331)..(331): a, c, t, g, unknown or other
  misc_feature (331)..(331): n is a, c, g, or t
  modified_base (371)..(371): a, c, t, g, unknown or other
  misc_feature (371)..(371): n is a, c, g, or t
  modified_base (584)..(584): a, c, t, g, unknown or other
  misc_feature (584)..(584): n is a, c, g, or t
  modified_base (595)..(595): a, c, t, g, unknown or other
  misc_feature (595)..(595): n is a, c, g, or t
tcagtgatacgtctcacgaccggtgctcgatttagatcgtctgtgttgggtttgggggaggcttggtccagcctggggagtccctgcactctcctgtgtggcctctggattcacctttgagacctatgccttgacctgggtccgccaggctccgaggggagggactgggagtgggtcgcaggcatcgctggtggcggtcatgacacattctacgcaaactccgtgaggggccncttcatcatctccagagacaattcccaagaacatactgtctctgcaactcaaataacctgagaggcgaggacacggctatttattctgtgcggaaggngacagtagtagggaacgtacgtattttcgactccctccgntagtccgaactacgtttgactttacggcgggggacccgggaacctggtccgccgtctcctcacgccctaccgaccgaacgggcccagttcccggtcccttccccgtcggccctacccctccaccgaaacgcgccaccctcggcgggccacgtcgccggcccgtgggctcgaccgtcggtaccaacggtcctaaccgttccgaacgtacgttanaccgtaccggnggacgg

SEQ ID NO: 358680 - DNA, 589 bp, Homo sapiens
  misc_feature: GZ8MTXP02H4EPS.9.34.D01.1.454.CMB.2.raw
  modified_base (231)..(231): a, c, t, g, unknown or other
  misc_feature (231)..(231): n is a, c, g, or t
  modified_base (372)..(372): a, c, t, g, unknown or other
  misc_feature (372)..(372): n is a, c, g, or t
tcagtgatacgtctcacgaccggtgctcgatttagatcgtctgtgttggggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccnttcatcatctccagagacaatcccagaacatactgtctctgcaactcaaactaacctgagaggcgaggacacggcctatttatttctgtgacgaaggagacagtagtagggaacgtacgtatttttcgacttccctccgcngtcgactacttgattacgtgggggacccgggacccgtggtccgccgtctcctcacgccctaccaccgaacggcccacgtccggtccttcccccgtcgccctacccctcctaccgaaacgcgacctaccgtcggtcggggacacgacgccggcccgtcgggcctcgccgtcggacaacggtactaacgtccgaacgtacgtacaccgtacgtggacgg

SEQ ID NO: 358681 - DNA, 583 bp, Homo sapiens
  misc_feature: GZ8MTXP02H4YAT.9.34.D01.1.454.CMB.2.raw
  modified_base (328)..(328): a, c, t, g, unknown or other
  misc_feature (328)..(328): n is a, c, g, or t
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccgcttcatcatctccagagacaattccccagaacatactgtctctgcaactcaaataacctgagaggcgaggacacggccatttatttctgtgcgaaggnggcatatggaagtacgattttcgatcctccgcngtcgacactttgattacgnggggcccggggaaaccctggtccgcccgtctcccgtcacgccctccacccgaaacgggccccaatccggtccttcccccgtggccacccctcctcccaaagacgccacctcgtcgggggcaccgagccggcccgtggggctcggcctcgggttaccaaacgggcttaaccttcccgaacgtaccgtataccacttacggacgg

SEQ ID NO: 358682 - DNA, 531 bp, Homo sapiens
  misc_feature: GZ8MTXP02HI9A4.9.34.D01.1.454.CMB.2.raw
  modified_base (351)..(351): a, c, t, g, unknown or other
  misc_feature (351)..(351): n is a, c, g, or t
  modified_base (462)..(462): a, c, t, g, unknown or other
  misc_feature (462)..(462): n is a, c, g, or t
  modified_base (466)..(466): a, c, t, g, unknown or other
  misc_feature (466)..(466): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactgtaccaacaacttccaggaacacgcccccaaagtcatcatttatagacaacatcgaagccgccctcgacgggtcccngccgtattctccggctaccaagtctggcacactcacgccctcccgtgcccagtccacgtcgggctccgaggctggagatggagcgtagacttattacgtcgcagtcgttancganacggtcgacctaacgtaacattcgtcgttacggacgttacggaccgtaacggtcctaccgtccgg

SEQ ID NO: 358683 - DNA, 585 bp, Homo sapiens
  misc_feature: GZ8MTXP02I5I5Z.9.34.D01.1.454.CMB.2.raw
  modified_base (325)..(325): a, c, t, g, unknown or other
  misc_feature (325)..(325): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacagtcggggcacgttatgatgtacactaggtaccaacaacttccaaggaaccacgacccccaaagtcatctatttanagacaacatacgaagccgccctacgacgggtccctcgaccgtacttccgtccggacctaccgaacgtctcgggaccacactccacgtccctcccgtcggccctatccacgtcggcctccgaggctagagatggagcgtagtactattaccgtgaccgtagtacgtagtcgaaccgtaggtacggtaaccttaaacgtaactacgttacgtaacgttacggaacgttacggggaacctaacggtccgtaaccggttcccgg

SEQ ID NO: 358684 - DNA, 705 bp, Homo sapiens
  misc_feature: GZ8MTXP02H6QDT.9.34.D01.1.454.CMB.2.raw
  modified_base (255)..(255): a, c, t, g, unknown or other
  misc_feature (255)..(255): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactgggagtggggtcgcaggcatcgctggtggcggtcatgacacattctacgaccaaactccggtggaggggccgcttcatcatctcaganacaatcccaagaacatactgtctctcgacaactacaaataacctgaggagcgaggacacggctatttattcgtgtgacggaaggagctagtagtagggtaaacgtacgtattttacgacttccctacgcacgtacaactactttgaacgttacgggtacgggggacccgggtaacccttcgggtcccgtcccgtcctccctccgacgtcccctacccgaaccgaaaccggggtcccctacgttcccggttcccccgttccccgtcggtacccctacccccgttcccaacccgaaacgaccggtaccctacccgttcggggaccgggggaccaacgggacccggcccgggccccggttcggggccttccgggtacccgttacgggtaaccgtaaaccgggtaccttaaccccgtacgaacggtaacgtactacccgtacgacgggaccggg

SEQ ID NO: 358685 - DNA, 590 bp, Homo sapiens
  misc_feature: GZ8MTXP02FM3Y2.9.34.D01.1.454.CMB.2.raw
  modified_base (366)..(366): a, c, t, g, unknown or other
  misc_feature (366)..(366): n is a, c, g, or t
  modified_base (388)..(388): a, c, t, g, unknown or other
  misc_feature (388)..(388): n is a, c, g, or t
  modified_base (528)..(528): a, c, t, g, unknown or other
  misc_feature (528)..(528): n is a, c, g, or t
  modified_base (578)..(578): a, c, t, g, unknown or other
  misc_feature (578)..(578): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggcgcaggcatcgctggtggcggtcatgacacattctacgcaaactccgtgaggggccgcttcatcatctccagagacaacttcccagaaacatactgtctctgcaactcaaataacctgagaggcgaggacacgctatttattctgtgcgaaggagcatagtagggaatacgtatttcgactccctccgacncgtcgactactttgattacggngggggacccgggtaaccctggtccgccgtctccctcacgccctaccaacccgaacgggccctacgttccggtcccttcccccgtcggcccacccctcctaccaagacgccaccgtcgcggggccacgacgccggtcccgngggtcctcggccgtcggtaccgaaacgtccgtaactccgacgtacgtacncgacgtggacgg

SEQ ID NO: 358686 - DNA, 591 bp, Homo sapiens
  misc_feature: GZ8MTXP02HE32S.9.34.D01.1.454.CMB.2.raw
  modified_base (232)..(232): a, c, t, g, unknown or other
  misc_feature (232)..(232): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (359)..(359): a, c, t, g, unknown or other
  misc_feature (359)..(359): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaatacctgagagcgaggacacggctatttattcngtgcgaaggngcatagtggaactacgtatttcgactccctccgncgtcgactacgtttgacttacgtgggggcccgggtaacccgtggtccgccgtcctcctcgacgtccctaccgaaccgaacgggccctacgtcccggtccctttcccccgcggtaccctcccctaccgtaccaaacgcgccaaccgtcggacgggggcacgcgccggccgtcgggcctcggaccgttcggaccaggtacctaacttaccgacgtacgtactcgacgtcgacgg

SEQ ID NO: 358687 - DNA, 586 bp, Homo sapiens
  misc_feature: GZ8MTXP02HJDG6.9.34.D01.1.454.CMB.2.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccgcttcatcatctccagagacaattcccaagaacatactgtctctgcaactcaataacctgagaggcgaggacacggccatttatttctgtgcgaaggacggcatagtgggaacgtagtattttcgattcccctcgctgttgactacgtttgaattacgtgggggcccggggtaaacccgtggtccgccgtctcctcacgccctccaccgaacgggcccacgtccggtcccttcccccggccaccctcctaccaacgaccgccaccgtcgcgggggccaacgcgccggtccgtcgggctcgccgtcggtacgaaacggtcctaacgtccgaagaccgtactcgacgtagacggcggg

SEQ ID NO: 358688 - DNA, 694 bp, Homo sapiens
  misc_feature: GZ8MTXP02I2M2K.9.34.D01.1.454.CMB.2.raw
  modified_base (191)..(191): a, c, t, g, unknown or other
  misc_feature (191)..(191): n is a, c, g, or t
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (344)..(344): a, c, t, g, unknown or other
  misc_feature (344)..(344): n is a, c, g, or t
  modified_base (586)..(586): a, c, t, g, unknown or other
  misc_feature (586)..(586): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgccgcctnagtgtctcggggaccccagggcagacgggtccaccatctcgtcgcacgtggaactgctacccganagtcgggcacgttntgactcgtacacgtggtaaccaactacgtttaccgaggacctacgtaccccaaagttcccattctaagtttacncgtaactaaacgtagtaccgaacgtccggtcctacggtacggggttcccctagggtaccgtcgtttaccggtaccgtacccgttacgtaacggtcccggtttaccgggtaccacgttaccgtacgtacggtcccttacccgtcgtacctacgtaccgtacgttcgtaaccgtccgtaggtaccgtaggacgtacggtgtaaacccggtgtacgtacgttacgttacgtgttaaccccgggtnttaccggtacgttacggaacgttacgggtaccgtaacgttaacgtaaccgtcgggttacgttccgtacggtaaccgtacggtacgtacgtcccggtaaaccgtttcgg

SEQ ID NO: 358689 - DNA, 570 bp, Homo sapiens
  misc_feature: GZ8MTXP02FNPEP.9.34.D01.1.454.CMB.2.raw
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggcatttatttctgtgcgaaggaggcatatgggaagtacgatttcgatcccncgcngtcgacactttgatttacgcgggggcccggggaaccctggtccggccgtctcctcacgccctacacccgaagggcccagtccggtccttccccctcggcctaccccctcctacccgaaacgacgccacccgtcgtcgggggcacgacgcggcccctggggcctcgcctcggtacaaggacctaacgtccgaacgacgtatcacgtgacgg

SEQ ID NO: 358690 - DNA, 551 bp, Homo sapiens
  misc_feature: GZ8MTXP02IA7C2.9.34.D01.1.454.CMB.2.raw
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (381)..(381): a, c, t, g, unknown or other
  misc_feature (381)..(381): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaatacgattttcgatcccnccgcngtcgactactttgattacgngggggcccgggaacccgtggtcgccgtctcctcagccctcaccagggcccatcggtccttcccctggccaccctcctccaacgacgccacctcgtgggggacacgacgccggccctgggcctcggacctcggtacaacggtactaacttccgagtacgtatcactgacgg

SEQ ID NO: 358691 - DNA, 693 bp, Homo sapiens
  misc_feature: GZ8MTXP02GKB13.9.34.D01.1.454.CMB.2.raw
  modified_base (326)..(326): a, c, t, g, unknown or other
  misc_feature (326)..(326): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgcctcagtgtcgtcggggccccagggcagagggtcaccatctcgtgcacgtggaagtacgctcaacagtcgggcacgttatgatgtacactacggtaaccaacaactaccaggaacacgaccccaaagtcatctaatttanacgacaaacatacgaacgccggccctacggacggggtccctaggaccgtacttccgtacccggtcctacccgaacgttccgtcgggaccaactactccgaaccggtcccctaccccgtcggaccctaagtcccgtaacgttccgggggacccttacccggaacggtccgttaggaacggggttaacgtacgggtacggtacttaacggtaacgtttaacgttaccgtacggtaccgtaacggttacgttaacgtacggtaacgtacggttaacggtaaaccttaaacgtaaaccgttcgttaccggttaaccgttaaccgggtaaacggtaccgggaacccgttaacggtacccgtaccggttccgg

SEQ ID NO: 358692 - DNA, 616 bp, Homo sapiens
  misc_feature: GZ8MTXP02IKIKC.9.34.D01.1.454.CMB.2.raw
  modified_base (335)..(335): a, c, t, g, unknown or other
  misc_feature (335)..(335): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgccgccctcagtgtcgtcggggccccagggcaggagggtcaccatctcgtgcacgtggaagtagctaccaacacgtcggggactacgttatgatgtacacgtacgtaaccaactaactccgaaggaacacgaccccaaagtcatctaattanagaacaacatacgaacgccggaccctacggtacggggtccctagacccgtacttccgtaccggcctacctaagtcctacggaccaactactccgacgtccctcccgtcggaccactccacgtcggcctaccgaggctaggacgatggaggctagtaaccttagtacgtcgaccgtagtccgttagacgaacgtacggtacggtaaacccttaaagtaaactcgttaccgtaacggttacggaaacggttcgggaaacctaacggttcccaaccggttccgg

SEQ ID NO: 358693 - DNA, 564 bp, Homo sapiens
  misc_feature: GZ8MTXP02JW4TB.9.34.D01.1.454.CMB.2.raw
  modified_base (320)..(320): a, c, t, g, unknown or other
  misc_feature (320)..(320): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcacgtggaagtagctccaacagtcggggcacgttatgatgtacactggaaccaacaacttccaggaacacgccccaaagtcatcatttangaacaacatcgaagccgccctcgacggggtccctggaccgacttcgtccggctaccaagtctcggcacactcacgccctcccgtgacccatccgacgtcggggacctccgacggtcctggaggtatgggacggctacgaacttagttaactcgaccgtagtcgtaactggacgacggttcgactaaacgtaaactcgttcgtcgttacggaacgtacgggaccgaacggtaccgaccgttccgg

SEQ ID NO: 358694 - DNA, 566 bp, Homo sapiens
  misc_feature: GZ8MTXP02F25ST.9.34.D01.1.454.CMB.2.raw
  modified_base (320)..(320): a, c, t, g, unknown or other
  misc_feature (320)..(320): n is a, c, g, or t
  modified_base (520)..(520): a, c, t, g, unknown or other
  misc_feature (520)..(520): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctcggggccccagggcagagggtcaccatctcgtgcactggaagtagctccaacatcggggcacgttatgatgtacactggtaccaacactccaaggaacacgacccccaaagtcatacatttanagacaacatacgaacgccggccctacgacggggtccctagaccgtacttccgtacccggcctaccgaaagtccgtacgggaccacactccacgcccttcccgtaggcccctatccgacgtcgggcctaccgacggctaggaggatgaggctagactagttactgacctagtcgtatgacacggtcggacctaacgtaacngtacgtcgtacggaacgtacggaccgtaacggtccaaccgttccgg

SEQ ID NO: 358695 - DNA, 652 bp, Homo sapiens
  misc_feature: GZ8MTXP02HZLOQ.9.34.D01.1.454.CMB.2.raw
  modified_base (305)..(305): a, c, t, g, unknown or other
  misc_feature (305)..(305): n is a, c, g, or t
  modified_base (351)..(351): a, c, t, g, unknown or other
  misc_feature (351)..(351): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctggggggaggcttggtccagcctggggagtccctgcgactctcctgtgtggcctctggattcacctttgagacctatgccttgacctgggtcccgccaggctccgagggggagggactgggagtgggtcgcaggcatcgctgggtggcggtcatgacacattcacgcaaactccgtgagggccncttcatcatctccagacgacaacttcccaagaacatactgtctctnacaacctcaaataactgagaggcgaggacacggcctagttttacttcgtagtcgacggaaggaggctaagtagtagggtaaagttacgtattttacgacttccccgtcgacgtacgtaccgtacgttacgttttcgggtaccggtcgggggtacccggggtaacccgtgggtcccgtccgttcctccgtcaccggtccctaccgaacccgaaccgggcccctacgtcccggttccccttcccccgtacggtccccctaccccgttacccacccgaaacgccgtacccgtacccgtccgggg

SEQ ID NO: 358696 - DNA, 608 bp, Homo sapiens
  misc_feature: GZ8MTXP02HX3OS.9.34.D01.1.454.CMB.2.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatagtgggaacgtacgtatttttcgacttcccctccgctagtcgactactttgattacgtggggcccggggaaccctggtccgccgtctcctcacgccctccaccaacgggcccacgtcggtcccttccccctcggccacccctcctacccaagcgcctacccgtcgtcgggggccaacgcggccggcccgttggggcctcgggtacccgtcggtaccgaacgggtaccttaaccgtttacccgaacggtaccgtacgtaccgacgttacggccggg

SEQ ID NO: 358697 - DNA, 693 bp, Homo sapiens
  misc_feature: GZ8MTXP02JPJUU.9.34.D01.1.454.CMB.2.raw
  modified_base (256)..(256): a, c, t, g, unknown or other
  misc_feature (256)..(256): n is a, c, g, or t
tcagtgatacgtctcacgaccggtgctcgatttagatcgtctgtgttgggtttgggggaggcttggtccagcctgggggagtccctgcgactctcctgtgtggcctctggattcacctttgagacctatgccttgacctgggtccgccaggctccgagggggagggactgggagtgggtcgcaggcatcgctgggtggcggtcatgacacattctacgcaaactccgtggacggggccgcttcatcatctccaganacatcccaagaacatactgtctctgacaactcaaataaccgtgaagaggcgaacggacacggctatttattcgtggtgacggaaggaggacaagtaggtagggaacgtacgttagtttaccgacttccccgacgctacgtacgtaacttacgtttagaacgtttacgggtccgggggacccgggtaacccgttcgggtcccgtcccgttcgtccctcgaccgtcccctaccgaacccggtaaccgggacccctacgttcccgggttccccttcccccgcggtacccctacccccgtacctaaccgaaacggccgtacccgtacccggttcggggccgggggaccaacggccggtcccgggtccccgtggggcctcggtccggtacggtaccgaacgtacctaacgtaccgacggtactacgtcgaacgtcggacggg

SEQ ID NO: 358698 - DNA, 720 bp, Homo sapiens
  misc_feature: GZ8MTXP02IQK03.9.34.D01.1.454.CMB.2.raw
  modified_base (240)..(240): a, c, t, g, unknown or other
  misc_feature (240)..(240): n is a, c, g, or t
  modified_base (284)..(284): a, c, t, g, unknown or other
  misc_feature (284)..(284): n is a, c, g, or t
  modified_base (382)..(382): a, c, t, g, unknown or other
  misc_feature (382)..(382): n is a, c, g, or t
  modified_base (511)..(511): a, c, t, g, unknown or other
  misc_feature (511)..(511): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactgggaggtgggtcgcgaggcatcgctgggtgggcggtcatgacacattctacgacaaactccgtggaggggccncttcatcatctccagagacaactcccaagaacatactgtctctnacaactacaaataacctgaagaggcgaggacacggcctattttattctgtgacggaaggagacatagtaggtaactacgtatttcgacttcccgccgnagtcgaactactttagacgttacggtcgggggacccgggtaaacccgttggtcccgtcccgttctcccgtcgacgtcccctaccaaccggaaacgggtcccctaagtccccggttcccctttcccccgngggtacccctaacccccgtttcctaacccggaaaacgtccgacccgtaacccgttcggggtacgggggaccctaaaaccggacggggtccccgggtaccccgggttgggggaccctttacgggtccccgttaggggtaaacccgaaaacgggtccctttaaaccgttccgaaacggttaaccgtaacctccgtaacgttcggaccgggg

SEQ ID NO: 358699 - DNA, 594 bp, Homo sapiens
  misc_feature: GZ8MTXP02GQOKG.9.34.D01.1.454.CMB.2.raw
  modified_base (232)..(232): a, c, t, g, unknown or other
  misc_feature (232)..(232): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccaagaacatactgtctctgcaactcaaataacctgagaggcgaggacacggcctatttatttctgtgacgaaggagcatagtgggaaagtacgtattttcgactccctccgcagtcgactactttgacttacgtcgggggacccgggaacccgtgggtccgcccgtctcctcacgccctccaccgaacgggcccagtccggtcccttcccccgtcggcccacccctcctaccaaacgcgccaccgtcgtcgggggaccacgacgccggccccgtgggcctcggcccgttcggaccaacggacttaaccgtcccgaagtacgtactcacgtcggacgg

SEQ ID NO: 358700 - DNA, 592 bp, Homo sapiens
  misc_feature: GZ8MTXP02F3D1W.9.34.D01.1.454.CMB.2.raw
  modified_base (330)..(330): a, c, t, g, unknown or other
  misc_feature (330)..(330): n is a, c, g, or t
  modified_base (496)..(496): a, c, t, g, unknown or other
  misc_feature (496)..(496): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctcggggccccagggcaggagggtccaccatctcgtgcacgtggaagtagctaccaacagtcggggctacgttatgatgtacacgtagtaaccaacaactccaaggaaccacgaccccaaagtcatctatttanagaacaaacatacgaacgccggaccctcgacggggtcccacgtaccgtacttccgtccggtacctaccgaagttccgtacggaccacgtactccgacgtcccctcccgtcggccctatccgacgtcgggcctaccgaggctaggagatggagctagacttattacngacctagtcgtatcgacgtaggtacggacctaaagtaactcgttaccggtaacgttacggaacgtcggggaaacctacggtaccgtaccggtccgg

SEQ ID NO: 358701 - DNA, 572 bp, Homo sapiens
  misc_feature: GZ8MTXP02IEC1C.9.34.D01.1.454.CMB.2.raw
  modified_base (232)..(232): a, c, t, g, unknown or other
  misc_feature (232)..(232): n is a, c, g, or t
  modified_base (561)..(561): a, c, t, g, unknown or other
  misc_feature (561)..(561): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaaataacctgagaggcgaggacacggcctatttatttctgtgcgaaggaggcatagtggggaagtacgtatttttcgactccctccgctgtcgactacgtttgactttacggcgggggacccgggaacccgtggtccgccgtctcctcacgccctaccaccgtacggcccagtccgtcccttcccgtcgccctacccctcctaccaacgcgcctaccgtcggtcggggcacgcgccgcgtcggcgtacgcgtcgacacgtactaactcgacgtacgtacncctagacgcgg

SEQ ID NO: 358702 - DNA, 609 bp, Homo sapiens
  misc_feature: GZ8MTXP02FTGX3.9.34.D01.1.454.CMB.2.raw
  modified_base (231)..(231): a, c, t, g, unknown or other
  misc_feature (231)..(231): n is a, c, g, or t
  modified_base (263)..(263): a, c, t, g, unknown or other
  misc_feature (263)..(263): n is a, c, g, or t
  modified_base (331)..(331): a, c, t, g, unknown or other
  misc_feature (331)..(331): n is a, c, g, or t
  modified_base (394)..(394): a, c, t, g, unknown or other
  misc_feature (394)..(394): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccncttcatcatctccagagacaattcccagaacntactgtctctgcaactcaaataacctgagaggcgaggacacggcctattttacttctgtgacgaaggnggacagtagtgggaactacgtatttcgactccctccgctagtcgaactactttgacttacggngggggcccgggaaccctggtccgccgtcgtcctcgacgccctccaaccgaacgggccctacgtccggttcccttcccccgtcggccctaccccgtccctaccgaaacgacgtccacccgttcggacgggggcccacgacggcccggcccgtgggccgtcggccgtcgggtacaacggtactaaccgttcccaggtacctatacacgtacggacgg

SEQ ID NO: 358703 - DNA, 581 bp, Homo sapiens
  misc_feature: GZ8MTXP02G1E8K.9.34.D01.1.454.CMB.2.raw
  modified_base (325)..(325): a, c, t, g, unknown or other
  misc_feature (325)..(325): n is a, c, g, or t
  modified_base (537)..(537): a, c, t, g, unknown or other
  misc_feature (537)..(537): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgcctcagtgtcgtcgggccccagggccagagggtcaccatctcgtgcactggaagtacgctccaacagtcggggactacgttatgatgtacactgtaaccaacaacttcaggaacacgaccccaaagtcatactatttanagacaaactatcgaacgccgaccctacggacggggtccctaggacccgtacttccgtccggtacctccgtaacgtcgtcggacactactcacgccctcccgtcgacccatccgacgtcggcctacgtaggctaggacgagtaggacgtacgtagtactacgttactcgtaccgtagtacgtacgtgacgtacgtacgtactaacgtaacgtntaccgtcgttacggaacgtacggacgtaacgtcgtaccgttcgg

SEQ ID NO: 358704 - DNA, 637 bp, Homo sapiens
  misc_feature: GZ8MTXP02HO801.9.34.D01.1.454.CMB.2.raw
  modified_base (232)..(232): a, c, t, g, unknown or other
  misc_feature (232)..(232): n is a, c, g, or t
  modified_base (368)..(368): a, c, t, g, unknown or other
  misc_feature (368)..(368): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccaagaacatactgtctctgcaactcaataacctgagaggcgaaggcacggcctatttatttctgtgacgaaggaggcagtagtgggaatacgtattttcgatccctccgcncgtcgactactttgattacggtcgggggcccgggaaccgtggtccgccgtctcctcacgccctccacccgaacgggccccacgtccggtcccttacccccgtcggtccctacccctccctacccgaaacgaccgcctaacccgtcggtcgggggacaccgacggcccgggccccgttggggcccttcggcccgtacgggtaccgaaacggggtaccctttaaacccgttcccgaaacggtaccgtaactccgaaccgttcggaccgggg

SEQ ID NO: 358705 - DNA, 594 bp, Homo sapiens
  misc_feature: GZ8MTXP02HL3FQ.9.34.D01.1.454.CMB.2.raw
  modified_base (233)..(233): a, c, t, g, unknown or other
  misc_feature (233)..(233): n is a, c, g, or t
  modified_base (320)..(320): a, c, t, g, unknown or other
  misc_feature (320)..(320): n is a, c, g, or t
  modified_base (330)..(330): a, c, t, g, unknown or other
  misc_feature (330)..(330): n is a, c, g, or t
  modified_base (369)..(369): a, c, t, g, unknown or other
  misc_feature (369)..(369): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccaagaacatactgtctctgcaactcaataacctgagaggcgaggacacggcctatttattcngtgcgaaggnggcatagtagggaacgtacgtattttcgactccctcgcngtcgactacgtttgattacggcgggggcccgggaaccctggtccgccgtctcctcacgccctccaccgaacgggcccacgtccggtcccttccccgtcggccctaccccgtccctaccaacgacgccacccgtcgtcggggacacgcggtcggcccgtgggcctcgaccgtcggtaccgaacggtacctaaccgttaccgacgtacgtactccgacgtcggacgg

SEQ ID NO: 358706 - DNA, 568 bp, Homo sapiens
  misc_feature: GZ8MTXP02G4ERQ.9.34.D01.1.454.CMB.2.raw
  modified_base (232)..(232): a, c, t, g, unknown or other
  misc_feature (232)..(232): n is a, c, g, or t
  modified_base (249)..(249): a, c, t, g, unknown or other
  misc_feature (249)..(249): n is a, c, g, or t
  modified_base (373)..(373): a, c, t, g, unknown or other
  misc_feature (373)..(373): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgagggccncttcatcatctccaganacaattcccagaacatactgtctctgcaactcaataacctgagaggcgaggacacggcctatttattctgtgacggaaggaggctaatagtagggaaacgtacgtattttcgactcccctcgcngtcgactacgtttgattacggcgggggacccgggtaaccctggtccgcccgtctcctcacgccctccacgacggcccagtccgtcctccccgtgccaccctccacaacgacgccaccgtcgtcggggcacgcggccggccgtcggctcgcccgtgtaccaaggtacctaacgtcgacgtactatccacgtgacgg

SEQ ID NO: 358707 - DNA, 658 bp, Homo sapiens
  misc_feature: GZ8MTXP02I0ZDP.9.34.D01.1.454.CMB.2.raw
  modified_base (329)..(329): a, c, t, g, unknown or other
  misc_feature (329)..(329): n is a, c, g, or t
  modified_base (366)..(366): a, c, t, g, unknown or other
  misc_feature (366)..(366): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtcgtcggggccccagggcaggagggtcaccatctcgtgcacgtggaagtagctaccaacagtcggggctacgttatgatgtacactacggtaccaacaacttccaggaaccacgaccccaaagtcatcatttanagaacaacatacgaacgccgccctacgacgggtcccngccgtacttcccgccgacctaccgaagtcgtcggacacactccgacgccctcccgtacgccctactccgacgtcggggccctaccggagggtcctaggggaacggtacgtgggtaaccgggtcttacggttaaccttaagtttaaccgtcggtaccccgtaggttaccgttaatacgggtaaccggtaggttaccgggaaaccttaaaaggtaaaccctagtttacccggttaaccgttacgggaaaccgttacggggaaacccgtaacggtacccgaacccggtttcccgg

SEQ ID NO: 358708 - DNA, 587 bp, Homo sapiens
  misc_feature: GZ8MTXP02IRVP4.9.34.D01.1.454.CMB.2.raw
  modified_base (301)..(301): a, c, t, g, unknown or other
  misc_feature (301)..(301): n is a, c, g, or t
  modified_base (359)..(359): a, c, t, g, unknown or other
  misc_feature (359)..(359): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccaggggagggactgggagtgggtcgcaggcatcgctggtggcggtcatgacacattcacgcaaactccgtgaggggccnttcatcatctccagagacaattccccagaacatactgtctctgcaacctcaaataccngagaggcgaggcacggtcctatttatttcgtgtcgacgaaaggtaggacaagtagtaggggaaagtacgtatttcgactccctcgacagtcgactactttgacgttacgtcgggggcccgggaaccgttggccgtccgtctcctcacgccctacccaccgaacgggccctacgtcccggtccttcccccgtggcccctaccccgtccctaccaacgtacgcctacccg

SEQ ID NO: 358709 - DNA, 669 bp, Homo sapiens
  misc_feature: GZ8MTXP02HDW9L.9.34.D01.1.454.CMB.2.raw
  modified_base (232)..(232): a, c, t, g, unknown or other
  misc_feature (232)..(232): n is a, c, g, or t
  modified_base (327)..(327): a, c, t, g, unknown or other
  misc_feature (327)..(327): n is a, c, g, or t
  modified_base (388)..(388): a, c, t, g, unknown or other
  misc_feature (388)..(388): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgagggccncttcatcatctccagagacaatcccaagaacatactgtctctgcaactcaataacctgagaggcgaggacacggccatttattctgtgcgaaggnggcatagtggaacgtacgtattttcgactccctcgcagtcgaactactttgacgtttacgngggggcccggggaaacccttggtccgcccggttcctccctccgacgtcccctacccgaacccgaaacggggccccctaagtcccgggttcccctttccccccgtcgggtcccctacccccgtccctaacccgaaacgacggaccctaacccgtccggtcgggggccaacgaccggtcccgggccccgtggggccctacggccccgttcgggtaccgaaacgggtaaccttaaccgtttacccgaaacggtacccgttaactccgtaacgtcggaaccgggg

SEQ ID NO: 358710 - DNA, 555 bp, Homo sapiens
  misc_feature: GZ8MTXP02FF808.9.34.D01.1.454.CMB.2.raw
  modified_base (214)..(214): a, c, t, g, unknown or other
  misc_feature (214)..(214): n is a, c, g, or t
  modified_base (248)..(248): a, c, t, g, unknown or other
  misc_feature (248)..(248): n is a, c, g, or t
  modified_base (305)..(305): a, c, t, g, unknown or other
  misc_feature (305)..(305): n is a, c, g, or t
  modified_base (347)..(347): a, c, t, g, unknown or other
  misc_feature (347)..(347): n is a, c, g, or t
  modified_base (395)..(395): a, c, t, g, unknown or other
  misc_feature (395)..(395): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccnccaggctccagggggagggactgggagtgggtcncaggcatcgctgggtggcggtcatgacacattctacgcaaaactccgtgaggggccncttcatcatctccagagacaaattccccagaacatactgtcntgcaaacctcaaataacctgagaggcgaggacacggccatttatttcngtgcgaaggaggcatatgggaagtacgattttcgatccctcgcagtcgacactttgattaacgtgggggccggggaaccctgggtcgccgtctcctcacgccctccaccaaagggcccagtccggcttccccctggccaccctcctccaaagcgcacccg

SEQ ID NO: 358711 - DNA, 576 bp, Homo sapiens
  misc_feature: GZ8MTXP02HYUAE.9.34.D01.1.454.CMB.2.raw
  modified_base (214)..(214): a, c, t, g, unknown or other
  misc_feature (214)..(214): n is a, c, g, or t
  modified_base (303)..(303): a, c, t, g, unknown or other
  misc_feature (303)..(303): n is a, c, g, or t
  modified_base (392)..(392): a, c, t, g, unknown or other
  misc_feature (392)..(392): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccnccaggctccagggggagggactgggagtgggtcgcaggcatcgctgggtggcggtcatgacacattcacgcaaactccgtgaggggccncttcatcatctccagagacaattcccagaacatactgtctctgacaacctcaaatacctgagaggcgagacacggcctatttactttcngtgcgaaggagcatagtgggaagtacgtattttacgactccctcgcacgtcactactttagacttacgtgggggacccgggaaccgtcgggtccgccgtcctccgtcacgccctccaccgaacgggcccacgtccggtccttcccccgtggccctaccccgtcctacccaacgcgacctacccg

SEQ ID NO: 358712 - DNA, 552 bp, Homo sapiens
  misc_feature: GZ8MTXP02JF3GT.9.34.D01.1.454.CMB.2.raw
  modified_base (321)..(321): a, c, t, g, unknown or other
  misc_feature (321)..(321): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacagtcggggcacggttatgatgtacactggtaaccaacacttccaggaacacgcccccaaagtcatcatttangacaacatgaagcgccctcgacggggtcccngccgattcnccggctccaagtctggcacatcacgccctcccgtcgcccatccactcgggcctccgaggctggacggatggaggtctagacttagttactgaccagtcgtaagtcgacgtacggtacgaccttaaacgtaaccagtcgtaaccgttacggaaccgttacggggaaccctaaacggtccgtaaccgttccgg

SEQ ID NO: 358713 - DNA, 650 bp, Homo sapiens
  misc_feature: GZ8MTXP02G4HSM.9.34.D01.1.454.CMB.2.raw
  modified_base (231)..(231): a, c, t, g, unknown or other
  misc_feature (231)..(231): n is a, c, g, or t
  modified_base (362)..(362): a, c, t, g, unknown or other
  misc_feature (362)..(362): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccncttcatcatctccagagacatcccagaacatactgtctctgcaactcaataacctgagaggcgaggacacggcctatttattctgtgcgaaggagcatagtagggaactacgtatttcgactccctacgcncgtcgtactacgtttagacttacgggcgggggtaccccggggtaaacccgtgggtacccgcccgtcctccctcgacggtaccctcccgaacccggaacgggccccctacgttcccggttcccctttcccccgtggtacccctaccccctccgtaacccgaacgacgaccctaccgtcgggtcgggggaccacgacggtccggccccgtgggccgtccgcccgtacggtaccgaaacggtacctaaccgttaccgaacggttacctagtaccctacggtacggaccggg

SEQ ID NO: 358714 - DNA, 629 bp, Homo sapiens
  misc_feature: GZ8MTXP02H9GKD.9.34.D01.1.454.CMB.2.raw
  modified_base (233)..(233): a, c, t, g, unknown or other
  misc_feature (233)..(233): n is a, c, g, or t
  modified_base (322)..(322): a, c, t, g, unknown or other
  misc_feature (322)..(322): n is a, c, g, or t
  modified_base (335)..(335): a, c, t, g, unknown or other
  misc_feature (335)..(335): n is a, c, g, or t
  modified_base (443)..(443): a, c, t, g, unknown or other
  misc_feature (443)..(443): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtggaggggccncttcatcatctcagagacaattcccaagaacatactgtctctgacaactcaataacctgagaggcgaaggacacggcctattttattcngtgacggaaaggnggactaagtagtaggggaaacgttacgtatttttcgacttcccctcgcacgtcgaactacgtttgattacggcgggggacccggggaaccttgggccgtccgtctccncacgccctaccaaccgaacgggccctacgtcccggttcccttcccccgtggccctacccctccctaccgaaagaccgacccaccgttcgggcggggccacgacggcccggcccgttcgggcctcggccgtcggacgaaacggtaccttaaccgtaccaacggtacctactccacgtacggaccggg

SEQ ID NO: 358715 - DNA, 494 bp, Homo sapiens
  misc_feature: GZ8MTXP02J13EN.9.34.D01.1.454.CMB.2.raw
  modified_base (388)..(388): a, c, t, g, unknown or other
  misc_feature (388)..(388): n is a, c, g, or t
  modified_base (471)..(494): a, c, t, g, unknown or other
  misc_feature (471)..(494): n is a, c, g, or t
tcagtgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcgaggggtcccctgaccgattctccggctccaagtctggcacatcagccctccctggccatcacgtggctccaggctgagatgagctgactattactgccagtcgtatgacagtgacctaagtacatcgtctccggactggaccagtcaccgtctgggcacgcccaagtccacccaaccngtctcctactccgtccctacccctaccctcctacgacgtactacaccgacgtcggcggcggcgcggacgacgggaccagagannnnnnnnnnnnnnnnnnnnnnnn

SEQ ID NO: 358716 - DNA, 619 bp, Homo sapiens
  misc_feature: GZ8MTXP02FWH9X.9.34.D01.1.454.CMB.2.raw
  modified_base (232)..(232): a, c, t, g, unknown or other
  misc_feature (232)..(232): n is a, c, g, or t
  modified_base (249)..(249): a, c, t, g, unknown or other
  misc_feature (249)..(249): n is a, c, g, or t
  modified_base (369)..(369): a, c, t, g, unknown or other
  misc_feature (369)..(369): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccaganacaattcccagaacatactgtctctgcaactcaaataacctgagaggcgaggacacggccatttatttctgtgcgaaggaggcatatggggaacgtacgtattttcgacttccctccgcngtcgactacgtttgacttacgtcgggggacccggggtaaccctggtaccgccgtcctcctcacgccctcccaaccaacgggcccctagtccggtcccttcccccgtcggcccacccctccgtaccaaacgtctaccaccttcgtacgggggccacgacggcccggcccgtggggcccttcggcccgttcggtaccgaacgggtacctaaccgttcccgaacggtaaccgtattaccgacgtacggacggg

SEQ ID NO: 358717 - DNA, 617 bp, Homo sapiens
  misc_feature: GZ8MTXP02IKI4C.9.34.D01.1.454.CMB.2.raw
  modified_base (233)..(233): a, c, t, g, unknown or other
  misc_feature (233)..(233): n is a, c, g, or t
  modified_base (322)..(322): a, c, t, g, unknown or other
  misc_feature (322)..(322): n is a, c, g, or t
  modified_base (504)..(504): a, c, t, g, unknown or other
  misc_feature (504)..(504): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccagaacatactgtctctgacaactcaaataacctgagaggcgaggacacggcctatttatttcngtgacgaaggaggcaagtagtagggaagtacgtatttttccgacttccctccgctacgtcgtactactttgactttacggcgggggacccggggaacccgttggtccgccgtctcctcacgcctccaccgaacggcccagtccgtcccttccccgtcgcctacccctcctacccgaacgacncccaccgtccggtcggggaccacgacgccgggccccgtggggcctcggcccgtacggaccgtaaacggccttaaccgttaccgaacgtaccgtactaccgaacgtacggcggg

SEQ ID NO: 358718 - DNA, 640 bp, Homo sapiens
  misc_feature: GZ8MTXP02GC2F2.9.34.D01.1.454.CMB.2.raw
  modified_base (322)..(322): a, c, t, g, unknown or other
  misc_feature (322)..(322): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacagtcggggcacgtatgatgtacactggtaaccaaacaactcaaggaacacgacccccaaagtcatcaatttaanacaacaacatacgaacgcccgtacctacggtacgggtaccctacgaccgtacttccgtcccggacctaccgtaagtcgtcgaccaacactccgactccctcccgtccgaccactactacgtcggtccgtaccgacggacgtacggaggtagtaggacgtacgtacgtaacgttaacgttaacgtacgtaccgtacgtacgtaacgtacgaacgtacggtaacggtaaaccgtaaaacgtaaacgtaacgttaccgttaaccgttaaccggtaaaccggtaaccggtaaccgtaaaccggtaaccgtacccggtaccgg

SEQ ID NO: 358719 - DNA, 627 bp, Homo sapiens
  misc_feature: GZ8MTXP02I4MGW.9.34.D01.1.454.CMB.2.raw
  modified_base (325)..(325): a, c, t, g, unknown or other
  misc_feature (325)..(325): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagcccgccctcagtgtctcggggccccagggcagaggtcaccatctcgtgcactggaagtagctaccaacagtcggggcacgttatgatgtacactaggtaaccaacaacttccaggaaacacgaccccaaagtcatcaatttanagacaacatacgaacgccgaccctcgacggggtccctagaccgtattccgaccggtcctaccgaaagtcctacggaccacgtaactacacgtccctcccgtggccctaagtccaacgtcgggccttaccgaggtcctaggaggaagtacggacgtacgtagtaacttagttacgtacgaccgtagttacgtaatacgaccgtacggtacggtaaaccttaaaacgtaaccgtacgttaccgttaaccggttaaccggaaacggtacggtaaacccgtaacggttacccgtaacccggttccg

SEQ ID NO: 358720 - DNA, 647 bp, Homo sapiens
  misc_feature: GZ8MTXP02I9KOB.9.34.D01.1.454.CMB.2.raw
  modified_base (145)..(145): a, c, t, g, unknown or other
  misc_feature (145)..(145): n is a, c, g, or t
  modified_base (232)..(232): a, c, t, g, unknown or other
  misc_feature (232)..(232): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (367)..(367): a, c, t, g, unknown or other
  misc_feature (367)..(367): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccnccaggctccaggggagggactggagtgggtcgcaggcatcgctggtggcggtcatgacacattctacgcaaactccgtgaggggccncttcatcatctccagagacaatcccagaacatactgtctctgcaactcaaataacctgagaggcgaggacacggcctatttattctgtgacgaaggngcatagnggaaacgtacgattttcgacttccctccgcngtccatacctttgattacggtcgggggacccggggtaaaccctgggtacgcccgtactccgtccacgccctaccacccgacgggcccacgtccggttcccttcccccgtggtcccctaccccgttccctacccaacgaccggtccacccgtcggtcgggggaccaccgacggcccggtcccgtcggggtccgtacggtcccgttcgggtacccgaacggtaacccttaacccgtttacccgaacggtaaccgttctaccgtaacgttcggaacccggggg

SEQ ID NO: 358721 - DNA, 586 bp, Homo sapiens
  misc_feature: GZ8MTXP02HK6XJ.9.34.D01.1.454.CMB.2.raw
  modified_base (324)..(324): a, c, t, g, unknown or other
  misc_feature (324)..(324): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtcgtcgtcggggccccagggccaggacgggtcaccatctcgtgcacgtggaagtagctaccaacagtcggggcacgttatgatgacactgtaaccaacactcaggaacacgaccccaaagtcatcatttancgaacaacatacgaacgcgccctgacgggtccctagcccgtattccgtccggctaccgaagtctacggactacactcacgccctcccgtgaccatcacgtcggacctcgagtcgtaggagagtcgaaggcctagtaccttagttaccgcgtaccgtagttccgtaatcggaaccgtaggtacggtaacctaaaacgtaacctaacgttccggtaacgttacggaaacgtacgggaacccgtacggtacccgtaccgttccgg

SEQ ID NO: 358722 - DNA, 611 bp, Homo sapiens
  misc_feature: GZ8MTXP02H978C.9.34.D01.1.454.CMB.2.raw
  modified_base (369)..(369): a, c, t, g, unknown or other
  misc_feature (369)..(369): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggaatgggtcgcaggcatcgctggtggcggtcatgacacattctacgcaaactccgtgagggccgcttcatcatctccagagacaattcccagaacatactgtctctgcaactcaataacctgagaggcgaggacacggcctatttactttctgtgacgaaggaggcatagtgggaagtacgtattttcgactccctccgcngtcgactacgtttgacgttacggtgggggcccggggtaacccgtggtccgccgtctcctcacgcctccaccgacggccacgtcggtcccttccccgcggcctaccccgtcctacccgaacgacgccaccgttcgcgggggacacgacgccggccgtcggggcctcggcccgttcggtaccgtaacggaacccgttaaccgtttacccgaacggtacgttacgtaccgtaccgtaggccgggg

SEQ ID NO: 358723 - DNA, 627 bp, Homo sapiens
  misc_feature: GZ8MTXP02GR0DN.9.34.D01.1.454.CMB.2.raw
  modified_base (234)..(234): a, c, t, g, unknown or other
  misc_feature (234)..(234): n is a, c, g, or t
  modified_base (334)..(334): a, c, t, g, unknown or other
  misc_feature (334)..(334): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggagggactggagtgggtcgcaggcatcgctggtggcggtcatgacacattctacgcaaactccgtgaggggccncttcatcatctccagagacaattcccaagaacatactgtctctgcaactcaaataacctgagaggcgaggacacggcctatttatttctgtgacgaaggnggacaatagtaggggaacgtacgtatttttcgacttcccctccgacaggtccgactacgtttgaacgttacggtcgggggaccccggggtaacccgtcgggtcccgcccgtcctcccgttcgacgcccctaccaaccgaaccgggcccacgttcccgttcccttcccccgtcggccctacccctccctacccgaacgaccgccaccgtcggacggggccacgcggccggcccgtggcctcgccgtcggaccgaacggtacctaacgtaccgacgtactactccgacgtgacgg

SEQ ID NO: 358724 - DNA, 599 bp, Homo sapiens
  misc_feature: GZ8MTXP02F2XJT.9.34.D01.1.454.CMB.2.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggcctatttatttctgtgcgaaggagcagtagtgggaacgtacgtattttcgactcccgtccgctgtcgactactttgatttacgtcgggggacccgggaacctggtccgccgtctccctcacgccctccaccgacgggcccacgtccggtcccttcccccgtcggccctacccctccctaccaacgcgcccaccgtcggtcggggaccacgacggtccggcccgttggggcctcggccgtcggtaccgaacggtacctaaccgttaccacgtacgtactcgacgtcggacggg

SEQ ID NO: 358725 - DNA, 579 bp, Homo sapiens
  misc_feature: GZ8MTXP02GV2O9.9.34.D01.1.454.CMB.2.raw
  modified_base (328)..(328): a, c, t, g, unknown or other
  misc_feature (328)..(328): n is a, c, g, or t
  modified_base (363)..(363): a, c, t, g, unknown or other
  misc_feature (363)..(363): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggctatttattctgtgcgaaggngcatagtaggaagtacgtatttcgactccctcgcngtcgactacttgattacggcgggggcccgggtaacctggtccgccgtctcctcacgccctccaccgacgggcccacgtccggtcccttccccgcggcccacccctcctaccaacgacgaccaccgtcggtcggggaccacgacggccggcccgtgggcctcggccgtcggaccaacggtaccttaaccgtccgacgtacgtactcgacgtcgacgg

SEQ ID NO: 358726 - DNA, 607 bp, Homo sapiens
  misc_feature: GZ8MTXP02GKM3A.9.34.D01.1.454.CMB.2.raw
  modified_base (232)..(232): a, c, t, g, unknown or other
  misc_feature (232)..(232): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaaataacctgagaggcgaggacacggcctatttatttctgtgcgaaggagcatagtgggaacgtacgtatttttcgacttcccctccgctacggtccactacgtttgaacttacggtgggggacccggggaaccctggtccgccgtctcctcacgccctccaccgaacgggcccagtccggtcccttccccgtggccctaccctccgtaccaacgacgccaccgtcggtcgggggccaacgcggccggcccgttgggcctcgcccgtcggtaccgaaacggtaccttaaccgttccaacggtacgtactacgacgttcggaacggg

SEQ ID NO: 358727 - DNA, 692 bp, Homo sapiens
  misc_feature: GZ8MTXP02JDD3M.9.34.D01.1.454.CMB.2.raw
  modified_base (232)..(232): a, c, t, g, unknown or other
  misc_feature (232)..(232): n is a, c, g, or t
  modified_base (271)..(272): a, c, t, g, unknown or other
  misc_feature (271)..(272): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccaagaacattaccnntctctcacacactaactaacgtagagaggacggacggacgccgacgtactttattacgttgtagacggaggagagtagtagtacggtagtacgttagttacgtcgtccgccgtcgacgtacgtacgtacgttacgttacgtacgggtccggggtacccgggtacccgggttaccggtcccggtgcccgttcccgtccgaccctaccgacccgtacccggaccccgaacgggtccccggtaccgttccccggttcccgttccccctacccggtacccgtacccctacccgtacccgaaccgaaccggtccgtacccgggtccgtacggggaccgaccggaccggtccggggtcccgtcgggtccgtcgtccgtacggtaccgtaaccggtaccgtacgtaccgtacgtcaacgtacgtacg

SEQ ID NO: 358728 - DNA, 586 bp, Homo sapiens
  misc_feature: GZ8MTXP02GSPCD.9.34.D01.1.454.CMB.2.raw
  modified_base (318)..(318): a, c, t, g, unknown or other
  misc_feature (318)..(318): n is a, c, g, or t
  modified_base (329)..(329): a, c, t, g, unknown or other
  misc_feature (329)..(329): n is a, c, g, or t
  modified_base (576)..(576): a, c, t, g, unknown or other
  misc_feature (576)..(576): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagagcgaggacacggcctatttatttcngtgacgaaggngcatagtgggaactacgtattttcgacttccctcgctagtcgactactttgacttacgcgggggacccgggtaaccctggtccgccgtctcctcacgccctaccaccgaaacgggcccacgttccggtcccttcccccgtcggccctacccctcctacccgaacgacgccaccgtcgtcgggggccacgcgccggccccgtgggcctcgccgtcggtaccaacggtactaaccgtccagtacgtacncacgtgacgg

SEQ ID NO: 358729 - DNA, 594 bp, Homo sapiens
  misc_feature: GZ8MTXP02G8A8Q.9.34.D01.1.454.CMB.2.raw
  modified_base (214)..(214): a, c, t, g, unknown or other
  misc_feature (214)..(214): n is a, c, g, or t
  modified_base (305)..(305): a, c, t, g, unknown or other
  misc_feature (305)..(305): n is a, c, g, or t
  modified_base (322)..(322): a, c, t, g, unknown or other
  misc_feature (322)..(322): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccnccaggctccgagggggagggactgggagtgggtcgcaggcatcgctgggtggcggtcatgacacattctacgcaaactccgtgaggggccncttcatcatctccaganacaattccccaagaacatactgtctctgcaacctcaaataacctgagaggcgaggacacggcctatttattcgtgtgacgaaaggaggcaagtagtaggggtaagtacgtattttacgaccttccccgtcgacagtacgactatttgacgtttacgcgggggacccgggtaccgtggtccgccgtcgtccctcgacgccctaccgaccgtaacgggcccacgtccggtcccttcccccgtgccctacccctcctaccaacgcgacctacccg

SEQ ID NO: 358730 - DNA, 708 bp, Homo sapiens
  misc_feature: GZ8MTXP02GBQV6.9.34.D01.1.454.CMB.2.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattcacgcaaacctcgtggacgggcctcttcatcagtcctacagacgaactacttcccaagaacatactgtctctcgacaaactacaaactaaccgtgaaggaggacgaggaccaccggtacttaattttactttcgtggtagacggaaagggcgacagtaggtaggggtaacttacgttacttttacggaaccttccccgtacgacgtacgtaccgaaacttacgtttacgtaacgtttacgggcggggggtacccgggtaacccgttcgggtacccgtcccgttcctccctacgaccgccctacccgaaaccgaccgggccctacgttcccggttcccctccccgtacggcccctaccccttccaccgaacgccgaccgtacccgtcggggaccggggaccacgaccggcccggtcccgtcgggcctacggtccgtacggtaaccgaaacggttaccctaacgttccgaacggtactacctaccgtacgacggaccgggg

SEQ ID NO: 358731 - DNA, 540 bp, Homo sapiens
  misc_feature: GZ8MTXP02J1CKH.9.34.D01.1.454.CMB.2.raw
  modified_base (264)..(264): a, c, t, g, unknown or other
  misc_feature (264)..(264): n is a, c, g, or t
  modified_base (347)..(347): a, c, t, g, unknown or other
  misc_feature (347)..(347): n is a, c, g, or t
  modified_base (380)..(380): a, c, t, g, unknown or other
  misc_feature (380)..(380): n is a, c, g, or t
  modified_base (450)..(450): a, c, t, g, unknown or other
  misc_feature (450)..(450): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtccaccatctcgtgcactggaagagctccaacatcggggcacgttangatgtacactggtaccaacaacttccagaacagcccccaaagcatcatttatgacaacatgaagccgcctcgacggggtcccngcccgattcctccggctcccaagtctggcacgntccacgccctccccgtggcccactcacgttcgggcctccgaggcctggagatggacgcgtgactattacngtccgaagtcgtataggacaggtcggacgtaaacgtaaccgatcgtcgttaccggaacgtcggggtaaccaacggttcaacccggttccg

SEQ ID NO: 358732 - DNA, 568 bp, Homo sapiens
  misc_feature: GZ8MTXP02J1YMA.9.34.D01.1.454.CMB.2.raw
  modified_base (235)..(235): a, c, t, g, unknown or other
  misc_feature (235)..(235): n is a, c, g, or t
  modified_base (512)..(512): a, c, t, g, unknown or other
  misc_feature (512)..(512): n is a, c, g, or t
tcagtgatacgtctcacgaccggtgctcgatttagatcgtctgtgttggggtttgggggaggcttggtccagcctggggagtccctgcgactctcctgtgtggcctctggattcacctttgagacctatgccttgacctgggtccgccaggctccgaggggagggactggagtgggtcgcaggcatcgctgggtggcggtcatgacacattctacgcaaactccgtgaggggccncttcatcatctcagagacaattcccagaacatactgtctctgcaactcaaataacctgagaggcgaggacacggccatttattctgtgcgaaggaggcatagtgggaacgtacgtattttcgattcccctcgcagtcgacactttgattacgtcgggggcccgggaaccctgggtccgcccgtctccctcgacgccctccaccaacgggcccagtccggtcccttcccccgtggcccaccctccctaccaacgacgccaccgtcgtcgggggcacgngccggcccgtgggctcgccgtgtcaacggtctaacgtccagacgtatcactgacgg

SEQ ID NO: 358733 - DNA, 657 bp, Homo sapiens
  misc_feature: GZ8MTXP02FWN87.9.34.D01.1.454.CMB.2.raw
  modified_base (251)..(251): a, c, t, g, unknown or other
  misc_feature (251)..(251): n is a, c, g, or t
  modified_base (350)..(350): a, c, t, g, unknown or other
  misc_feature (350)..(350): n is a, c, g, or t
  modified_base (610)..(610): a, c, t, g, unknown or other
  misc_feature (610)..(610): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacgagggtcctgggcccagtctgttctgacgcacgccgccctcagtcgtccgtcggggcccccagggcaggacggtcaccatctcgtgcagtaggaagtcncctaccaacgagtcgggctacgttatagatgtacacgtacgtaaccaactaacctacgaaggaaccaccgaacccccaaagtcctaatactaattttanacgaacaaacgtaagtacggaaccgtcccggacccgttacggtaccggggtacccctacggtaccgtaccttcccgtacccggaccctaccgtaagtcctacggaccacgtactccgaccgtccctcccgtggaccctattacccgcggtacggcctaccgggagtacgtaggaaggtatagggacggtacctaggtaaccttacgtttacgcgtaccgtagttacgtagtaccggatacggtacgtaactaacgtaacncgttcgtaacgttaacgacgtaccggactaacggtcctaccgtacgg

SEQ ID NO: 358734 - DNA, 574 bp, Homo sapiens
  misc_feature: GZ8MTXP02GK04K.9.34.D01.1.454.CMB.2.raw
  modified_base (232)..(232): a, c, t, g, unknown or other
  misc_feature (232)..(232): n is a, c, g, or t
  modified_base (365)..(365): a, c, t, g, unknown or other
  misc_feature (365)..(365): n is a, c, g, or t
  modified_base (462)..(462): a, c, t, g, unknown or other
  misc_feature (462)..(462): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaaataacctgagaggcgaggacacggccatttatttctgtgcgaaggaggcatatgggaacgtacgatttttcgatccctccgnacgttcgactactttgattacgtgggggcccgggaaccctggtcgccgtctcctcacgccctccaccgaacgggccccatccggtcctttcccccgnggtcccacccctccctccaaacgacgtccaccgtcgtgggggcaccgaggccggcccgtgggctcgccgttcgacaaggtactaacttcccaagtaccgtatacactgacgg

SEQ ID NO: 358735 - DNA, 628 bp, Homo sapiens
  misc_feature: GZ8MTXP02H0IQM.9.34.D01.1.454.CMB.2.raw
  modified_base (328)..(328): a, c, t, g, unknown or other
  misc_feature (328)..(328): n is a, c, g, or t
  modified_base (383)..(383): a, c, t, g, unknown or other
  misc_feature (383)..(383): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgcgtggtggcggtcatgacacattctacgacaaactccgtggacggggccgcttcatcatctcagagacaattcccaagaacatactgtcctctgacaactacaaataacctgagaggcgaggacacggcctatttatttcngtgacggaaggaggacagtagtaggggaaactacgtatttcgacttcccgtccgnacgtcgactacgtttgactttacggcgggggcccgggtaaccgtcggtccgtccgtcctcctcgcgtaccctccgaaccgacgggccctacgtccggttcccttccccgcggtcccctaccccttccctaccgaagaccgaccaccgtcggacggggcacgcggccggccgtgggcctcggcccgttggaccgaacggtacctaaccgttccgaacgtaccgtaacttccgacgttacggacggg

SEQ ID NO: 358736 - DNA, 638 bp, Homo sapiens
  misc_feature: GZ8MTXP02HWCSJ.9.34.D01.1.454.CMB.2.raw
  modified_base (206)..(206): a, c, t, g, unknown or other
  misc_feature (206)..(206): n is a, c, g, or t
  modified_base (233)..(233): a, c, t, g, unknown or other
  misc_feature (233)..(233): n is a, c, g, or t
  modified_base (320)..(320): a, c, t, g, unknown or other
  misc_feature (320)..(320): n is a, c, g, or t
  modified_base (330)..(330): a, c, t, g, unknown or other
  misc_feature (330)..(330): n is a, c, g, or t
  modified_base (370)..(370): a, c, t, g, unknown or other
  misc_feature (370)..(370): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacanattctacgcaaactccgtgaggggccncttcatcatctcagagacaattcccagaacatactgtctctgcaaactcaaataacctgagaggcgaaggacacggccatttattcngtgcgaaggngcagtagtagggaagtacgtattttcgacttccctccgcncgttcgaactacgtttgaacttacgggtcgggggaccccgggggtaaacccttgggtccgcccgtctccctctacgccctccaacccgaacgggccccaagtcccggttcccttcccccgtcggtcccacccccttcccaccaaacgacgcctaacccgtcggacgggggccaaacgcggtcccggcccgttggggcctacggcccgtacggggtaccaaacggaccttaacttacccgagtaaccgtactacctacgtaggaccggg

SEQ ID NO: 358737 - DNA, 599 bp, Homo sapiens
  misc_feature: GZ8MTXP02GCHUH.9.34.D01.1.454.CMB.2.raw
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgcctcagtcgtcgtcggggccccagggcaggaggtcaccattctcgtgcacgtggaagtagctaccaacgacgtcggggactacgttatgatcgtacacgtacggtaaccaactaactccaaggaaccacgaccccaaagtcatctatttatagaacaacatacgaacgccgacctacgacgggtccctacgaccgtacttccgtccggtacctaccgaacgtccgtacggaccacgtactccgacgtccctacccgtcgacctagtccgcgtcggctccgagtcgtaggagacgtaggacgtctacgtacttagttacgcgaccgtagtacgtagtcgaactaggtacgacttaacgtaactcgttacgtaacgttaacggacgtacgggtaaccacggtactccggttaccgg

SEQ ID NO: 358738 - DNA, 666 bp, Homo sapiens
  misc_feature: GZ8MTXP02G63NV.9.34.D01.1.454.CMB.2.raw
  modified_base (275)..(275): a, c, t, g, unknown or other
  misc_feature (275)..(275): n is a, c, g, or t
  modified_base (338)..(338): a, c, t, g, unknown or other
  misc_feature (338)..(338): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacgagggtcctgggcccagtctgttctgacgcacgccgcctcagtcgtcgtcggggccccagggcaggaggtcaccatctcgtgcacgtggaacgtagctaccaacgacgtcgggactacgttangatacgtacactacgtaaccaactaactccgaagaaccacgaccccaaagtcatactaattanagaacaaacatacgaacgccgaccctacgacggggtcctacgccgtacttccgtaccggtcctaccgtaagtccgtacggaccaactaacctccgaccgtccccgttccccgtacggaccctaactcccgtaaccggtccggggccttaccggaacgggccgtacggggtaacggaggttacgggaacggtacgttaacggtaacctttaagttaaccgtcggtaaccctaggttaccgtagtacggaaacgtacggtacggtaaacctaagtaactacgttacgtccgttaacggacgtaacggaacgtacggtaccgtacgtccgg

SEQ ID NO: 358739 - DNA, 620 bp, Homo sapiens
  misc_feature: GZ8MTXP02HERPB.9.34.D01.1.454.CMB.2.raw
  modified_base (273)..(273): a, c, t, g, unknown or other
  misc_feature (273)..(273): n is a, c, g, or t
  modified_base (298)..(298): a, c, t, g, unknown or other
  misc_feature (298)..(298): n is a, c, g, or t
  modified_base (313)..(313): a, c, t, g, unknown or other
  misc_feature (313)..(313): n is a, c, g, or t
  modified_base (348)..(348): a, c, t, g, unknown or other
  misc_feature (348)..(348): n is a, c, g, or t
  modified_base (381)..(381): a, c, t, g, unknown or other
  misc_feature (381)..(381): n is a, c, g, or t
  modified_base (579)..(579): a, c, t, g, unknown or other
  misc_feature (579)..(579): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgaggggagggactggagtgggtcgcaggcatcgctggtggcgtcatgacncatcacgcaaactcgtgacgggccnttcatcatctcaganacatcccagacatactgtctctgcaactcaatacngacgaggcgaggacacggtcctatttactttcngtagacgaaggaggacagtagtagggtaagtacgtattttacgaacttccctaccgacgtacgttaccgaccttacgtttgaacgttaccggtacgggggaccccgggtaacccttcgggtccgccgttccgtcccttaccgacgtaccccgtaccaacccgaacgggcccctacgtcccggttaccctttcccccgnggtaccccaccccgttcccaccgaaacgccgacctacccgg

SEQ ID NO: 358740 - DNA, 661 bp, Homo sapiens
  misc_feature: GZ8MTXP02FKO3J.9.34.D01.1.454.CMB.2.raw
  modified_base (313)..(313): a, c, t, g, unknown or other
  misc_feature (313)..(313): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgcctcagtgtctgggccccagggcagaggtcaccatctcgtgcactggaagtagctccaacagtcggggcacggttatgatgtacactgtaccaacactccaggacagacccccaaagtcatcatttangacaacatcgacgccggccctcgacggggtcccctgccgacttcctccggctccaagtctggcaacactccacgtccctccccgtgacccactccgcgttcgggggccctcccgagggtcctggaagggtctacgggaacgggtcctttacggaacctttaaagtttacccgtgggaccccctaaggggttacccggttaaaacgtacggtaaaccgtacggttaaccgggtaaacccgttaaaacgtaaacccgtaacgtttacccggtaacccggttaaccggggtaaaacccggtaccgggggtaaaccccgtaaaccgggttaccccgtaccccgggttccggg

SEQ ID NO: 358741 - DNA, 618 bp, Homo sapiens
  misc_feature: GZ8MTXP02GQP55.9.34.D01.1.454.CMB.2.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggcctatttattctgtgcgaaggaggcagtagtgggaactacgtattttcgactccctccgcagtcgactactttgagttacgcgggggtacccgggaaccgtggtccgccgtctccctcacgccctccgaccgaacgggcccacgtccggttcccttcccccgtacggccctacccccgttccctacccgaacgacgaccacccgtcggtcgggggccaacgcgcccgggcccgttggggcctcggcccgttacggtacccgaaggtacctaacgttacccgaggtaccgtactaccgaacgttcggaccggg

SEQ ID NO: 358742 - DNA, 471 bp, Homo sapiens
  misc_feature: GZ8MTXP02F34FG.9.34.D01.1.454.CMB.2.raw
  modified_base (303)..(303): a, c, t, g, unknown or other
  misc_feature (303)..(303): n is a, c, g, or t
  modified_base (387)..(387): a, c, t, g, unknown or other
  misc_feature (387)..(387): n is a, c, g, or t
  modified_base (405)..(405): a, c, t, g, unknown or other
  misc_feature (405)..(405): n is a, c, g, or t
  modified_base (459)..(459): a, c, t, g, unknown or other
  misc_feature (459)..(459): n is a, c, g, or t
  modified_base (461)..(461): a, c, t, g, unknown or other
  misc_feature (461)..(461): n is a, c, g, or t
  modified_base (463)..(471): a, c, t, g, unknown or other
  misc_feature (463)..(471): n is a, c, g, or t
tcagtgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcgaggggtccctgaccgattctccggctccaagtctggcacatcacgccctccctggccatcactggctccaggctgagatgagctgactatacngccagtctatgacagtgactaaagacatcgtctaccggactgggacaaggtccaccgtctgggcacgcccaacgcccaaacccntcgtcactctcgtccccnccctcctcgacgtacgtatccacgtcgacggcgggctacgggacaacgggccanangnnnnnnnnn

SEQ ID NO: 358743 - DNA, 702 bp, Homo sapiens
  misc_feature: GZ8MTXP02GPAY0.9.34.D01.1.454.CMB.2.raw
  modified_base (231)..(231): a, c, t, g, unknown or other
  misc_feature (231)..(231): n is a, c, g, or t
  modified_base (388)..(388): a, c, t, g, unknown or other
  misc_feature (388)..(388): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggaggtcatgacacattcacgcaaactccgtgagggccncttcatcatctcagagacaattcccaagaacatactgtctctgaccaactacaaactaaccgtgagaggacgaggaccacggcctaattttattcgtggtgacggtaaggcgacaagtagtaggggaacgttacgtattttcgacttcccctaccgncgtcgacttacgtttgacgttacgggtgggggacccggggtaccttgggtcccgtccgtctcctcgacgccctaccgaccgaacgggcccctaggtccccggttcccttcccccgtcgggtacccctacccccgttccctacccgaaaacggccgacccgtaacccggttccggggaacgggggtccctaaaccgggacccgggtcccgggtccccggttgggggcccttccggggccgttacggggtaacccgaagggtacccttaacccgtaccggaacgttacgtacgtaccgtacggtacggaaccgggg

SEQ ID NO: 358744 - DNA, 575 bp, Homo sapiens
  misc_feature: GZ8MTXP02HUMZ5.9.34.D01.1.454.CMB.2.raw
  modified_base (365)..(366): a, c, t, g, unknown or other
  misc_feature (365)..(366): n is a, c, g, or t
  modified_base (383)..(383): a, c, t, g, unknown or other
  misc_feature (383)..(383): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcagacatcgctggtggcggtcatgacacattctacgcaaactccgtgaggggccgcttcatcatctccagagacaattcccagaacatactgtctctgcaactcaaataacctgagaggcgaggacacggcctatttatttctgtgcgaaggaggacatagtggaagtacgtatttcgactcctccgnngtcactctttgatacgnggggccgggaaccctggtcgccgtctcctcacgccctccaaccgaacgggccccaagtcccggtccttcccccgtacggccctaccccctcctacccgaaagacgccaccgtcgtgggggccaacgcgccggcccctggggcctcggccctggtaccaaggacctaacgttcaacgcgtatcgaactgacgg

SEQ ID NO: 358745 - DNA, 567 bp, Homo sapiens
  misc_feature: GZ8MTXP02HSLAI.9.34.D01.1.454.CMB.2.raw
  modified_base (248)..(248): a, c, t, g, unknown or other
  misc_feature (248)..(248): n is a, c, g, or t
  modified_base (372)..(372): a, c, t, g, unknown or other
  misc_feature (372)..(372): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgaggggagggactgggagtgggtcncaggcatcgctggtggcggtcatgacacattctacgcaaaactccgtgaggggccgcttcatcatctccagagacaatcccaagaacatactgtctctgcaacctcaaataacctgagaggcgnggacacggccatttattctgtgcgaaggaggcatatagggaagtacgtattttcgatccctcgcagtcgactactttgattacgtgggggcccgggaacctgggtccgccgtctcctcacgtccctccaaccgaacgggcccacgtccggtccctcccccgtcggcccaccctccctaccaaacgcgcctacccg

SEQ ID NO: 358746 - DNA, 585 bp, Homo sapiens
  misc_feature: GZ8MTXP02I2SFY.9.34.D01.1.454.CMB.2.raw
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (299)..(299): a, c, t, g, unknown or other
  misc_feature (299)..(299): n is a, c, g, or t
  modified_base (325)..(325): a, c, t, g, unknown or other
  misc_feature (325)..(325): n is a, c, g, or t
  modified_base (375)..(375): a, c, t, g, unknown or other
  misc_feature (375)..(375): n is a, c, g, or t
  modified_base (399)..(399): a, c, t, g, unknown or other
  misc_feature (399)..(399): n is a, c, g, or t
  modified_base (506)..(506): a, c, t, g, unknown or other
  misc_feature (506)..(506): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggagggactgggagtgggtcgcaggcatcgctgggtggcggtcatgacacattcaacgcaaactccggtggacggggccncttcatcatcnccaganacaacttcccaagaacatactgtctctgcaaactcaaataacngagaggcgagacacgctatttattcngtgacgaaggagctagtagtaggggaactacgtatttcgactccctcgcngtcactacgtttagagttaccggngggggacccgggtaacctggtccgccgtctcctcacgccctaccaccgaacgggccctagtcccggtcccttcccccgtggccctacccctccgtacaacgcgaccncccgtggcgggacacgcggtccgccgtggctcgccgtcgtacacgtctaaccgtacacgtacgtactacgactcgacgg

SEQ ID NO: 358747 - DNA, 606 bp, Homo sapiens
  misc_feature: GZ8MTXP02GMST6.9.34.D01.1.454.CMB.2.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagcccgccctcagtgtcgtcggggccccagggcagagggtcaccatctcgtgcactggaagtagctaccaacacgtcggggctacggttatgatgtacactggtaaccaaacaacttccaggaacacgacccccaaagtccatctaatttatacgaacaacatacgaacgccggaccctacgacggggtccctacgaccgtacttccgtccggtacctaccgtaaagtccgtacggacactactcacgtccctcccgtggcctactcacgtcgggtctaccgaggtcgtaggagatagggacggctacggtaacttattacgtcgaccgtgtacgtactaggaacgacggtacggaccttaaaacgtaacacgttacgtccgttacggaacgtcggggaaaccctacggtaccaacccgttccgg

SEQ ID NO: 358748 - DNA, 797 bp, Homo sapiens
  misc_feature: GZ8MTXP02GRE9Q.9.34.D01.1.454.CMB.2.raw
  modified_base (337)..(337): a, c, t, g, unknown or other
  misc_feature (337)..(337): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtcgtcggggccccagggcaggagggtcaccatctcgtgcacgtggaagtagcctccaaacagtccggggctacggttatgatgtaacacgtaggtaacccaacaacttccaaggaaccacgaccccaaagtcatctatttangaacaacatacgaacgccggacccctacgacggggtcccctaggacccgtatttacccgtcccgggccttacccgaaagttccgtacgggaccctaacgtaacttccgaacgtccccttccccgtacggacccctaacgttacccgaaccggttcgggggacccttacccggaaggggtcccgttaggggaacgggtaacgttacggggaaccggtccgttaacggtaaacctttaacgtttaaccgttcggaaccccgttaagggttacccggttaaaattaccggggtaaaccgttaacggggttaaccggggtaaaccctttaaaaacggggttaaaacccttaacgtttacccgggttaacccggttttaaacccgggggaaaacccggttttaccgggggaaaaccccgttaaaaccgggggtttccccgtaaaaccccggggttttccccgggg

SEQ ID NO: 358749 - DNA, 720 bp, Homo sapiens
  misc_feature: GZ8MTXP02G9Z6Z.9.34.D01.1.454.CMB.2.raw
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactgggagtgggtcgcaggcatcgctgggtggcggtcatgacacattcacgcaaactccgtggaggggccncttnatcatctcaganacaattcccaagaacatactgtctctgactaactacaaacttaaaccgtggaagagggacgaacgggaaccgaccggtcctaattttactttctggtaggacggtaaagggaggtactaagttaacggtaggggtaaaacgttacggttatttttaccgaaccttcccccgtacggctacggtccgtaaacttacgtttagtaacgtttaaccgggcggggggtaaccccgggggtaacccttcgggtacccgtcccgttcctccttaccgacggtcccctacccgaaccgaaccggggcccctaacggtcccgttccccgttcccccgccggtacccacccccgttccgaacccaaacgcgacctccgtacggtcggggaccaacgcggtccgaccggtcggcctcggacgtcggtacgaacggtactaaccgttacgaacgtacgtactaccgtaacgcgggaccgg

SEQ ID NO: 358750 - DNA, 662 bp, Homo sapiens
  misc_feature: GZ8MTXP02IVZF0.9.34.D01.1.454.CMB.2.raw
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
  modified_base (588)..(588): a, c, t, g, unknown or other
  misc_feature (588)..(588): n is a, c, g, or t
tcagtgatacgtctcacgaccggtgctcgatttagatcgtctgtgttgggtttgggggaggcttggtccagcctgggggagtccctgcgactctcctgtgtggcctctggattcacctttgagacctatgccttgacctgggtccgccaggctccgagggggagggactgggaggtgggtcgcaggcatcgctgggtggcggtcatgacacattcacgcaaactccgtggacggggcctnttcatcatctccaganactaacttcccaagaacatactgtctctnacaactacaactactagaggaggcgaaggacgacggtacctattttattgtgtagacggaaggaggactagtaggtagggtaacgttacgtacttttcgacttcccctccgatacgtccaacttacgtttagtacgtttacgggtcggggggtacccgggtacccgtggtcccgtccgtccgtccctacgacgtcccctaccgaaccgaccgggtccctacgtccggttcccctttccccgcggtccctaccccgtctaccgacgtacgccgtacgtcgggtcgggacacgacggccggccgngggtcctcggtcgtacgggtacgtaacggtaccttaaccgtccgtaacggtactacgtacgtacgtcggtacgg

SEQ ID NO: 358751 - DNA, 611 bp, Homo sapiens
  misc_feature: GZ8MTXP02IOAY8.9.34.D01.1.454.CMB.2.raw
  modified_base (235)..(235): a, c, t, g, unknown or other
  misc_feature (235)..(235): n is a, c, g, or t
  modified_base (295)..(295): a, c, t, g, unknown or other
  misc_feature (295)..(295): n is a, c, g, or t
  modified_base (320)..(320): a, c, t, g, unknown or other
  misc_feature (320)..(320): n is a, c, g, or t
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
  modified_base (373)..(373): a, c, t, g, unknown or other
  misc_feature (373)..(373): n is a, c, g, or t
  modified_base (555)..(555): a, c, t, g, unknown or other
  misc_feature (555)..(555): n is a, c, g, or t
  modified_base (596)..(596): a, c, t, g, unknown or other
  misc_feature (596)..(596): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggagggactggagtggggtcgcaggcatcgctggtggcggtcatgacacattcacgcaaactccgtggacgggccnttcatcatctcagagacaacttcccaagaacatactgtctctgacaaactcaaataaccngagaggcgaggacacggcctatttnttcngtgacgaaggngctatagtagggaactagtatttcgacttcccgccgtnacgtcgaacttgtttcgaagttcgggcgggggacccgggtacccgtgggtccaccgttcctccctacacgccctacccgaaccgaacgggccctagttcccggttcccttccccgtggtccctaccccgtctacccgaagtcacccgtacgtcggcggggcacgcggccgcccggtggtccncggtcgcgtacgaaacgtcctaaccgttacgacggtaactnaccgtacgtggccgg

SEQ ID NO: 358752 - DNA, 685 bp, Homo sapiens
  misc_feature: GZ8MTXP02JWMJ5.9.34.D01.1.454.CMB.2.raw
  modified_base (233)..(233): a, c, t, g, unknown or other
  misc_feature (233)..(233): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctcagagacaacttcccagaacatactgtctctgacaactcaataacctgagaggcgaggacacggcctatttattctgtgacgaaggaggacatagtagggtaacgtacgtattttacgaccttcccgtccgacacggtcgtacttaacgtttagaacgtttacggtcgggggaccccggggtaaacccgttcggtccgtcccgtccttcccgcacgcccctacccgacccgaacgggccccacgttcccggttccccttcccccgtacggccccctacccctcccgtaccgaacgaccggaccctaacccgtcggggtccgggggaccaaccgcgggccccgggtccccggtcgggtccgtcggtacccggttcgggaaccgaaacggttacccgttaacctacccggacgtaaccgtagttcccacggtacggaccgggg

SEQ ID NO: 358753 - DNA, 677 bp, Homo sapiens
  misc_feature: GZ8MTXP02FJJNZ.9.34.D01.1.454.CMB.2.raw
  modified_base (267)..(267): a, c, t, g, unknown or other
  misc_feature (267)..(267): n is a, c, g, or t
  modified_base (320)..(320): a, c, t, g, unknown or other
  misc_feature (320)..(320): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtacgctccaacgatcggggctacgttangatgtacactggtaccaacaacttccagaacacgaccccaagtcatcatttangacaactatcgaacgccggccctcgacggggtccctcggacccgtcttaccgtcccggtctaccaagtctggcacactcacgtccctcccgtcggaccctaactcgaaccgtcggggtccctacccggagggccttagggaacgggtagttacgggagggtcctacggtaacctttacgttaaccgtcggtacccgtacggttacggttaactacgggtaaacctaggggttaaccgggtaaccctttaaaacgttaaaacccgtagtttcccggttaaccgtttacccgggggtaaaccgttaccggggtaaaccccggttaaaacggggttccccgaacccgggtttaccccggg

SEQ ID NO: 358754 - DNA, 861 bp, Homo sapiens
  misc_feature: GZ8MTXP02IICCD.9.34.D01.1.454.CMB.2.raw
  modified_base (247)..(247): a, c, t, g, unknown or other
  misc_feature (247)..(247): n is a, c, g, or t
tcagtgatacgtctcacgaccggtgctcgatttagatcgtctgtgttgggtttgggctgacctggctttttctcgtggctgttttaaaaaggtgtccagtgtgaggttcaactgttggagtcgtggggggaggcttggtccagcctggggagtccctgcgactctcctgtgtggcctctggattcacctttgagacctatgccttgacctgggtccgcaggctcgaggggaggactggagtgggtcncgaggcagtcgcgtgggtggcggtcatgacactattcacgactaaacgtccggtaggacggggcctcttcatcactcctaccgaagaacgaaccaacttaccccgaaagtaaacctattaacctgtcctactacgacctaaaccctactaaaacgttaaccgtaggaacggaacgggaccgacggggaaaccgtaaaccggggtaccctttaagttttttaacgtttccggtaggttacgggaacgggtaaaaggggaacggtacgtaagttaaagggtaagggggtaaaacgttacggtttaacgtttttacccggaaccttcccccgtaccgtacgtaacggttaccgtaaacggttttaaccgttttacgggggttaaccggggtacccggggggtaccccggggttaaccccggttacgggttcccggtcccggtttacccgtcccgtaccgtaacccggtaccccgttacccgaaacccgggaaacccgggtacccccgttaacggtttcccccgggtttaaccccctttcccccggtacggtaacccccgttaaccccctaccccgtaacccgaaaacggtacccgtaacccgtacccgttccggggg

SEQ ID NO: 358755 - DNA, 673 bp, Homo sapiens
  misc_feature: GZ8MTXP02FNOC2.9.34.D01.1.454.CMB.2.raw
  modified_base (324)..(324): a, c, t, g, unknown or other
  misc_feature (324)..(324): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcacgtggaagtagctccaacagtcggggcacgtatgatgtacactggtaccaacaacttccaggaacacgaccccaaagtcatcatttatcganaacatcgaacgcggacccctcgacggggtcccctagcccgattccgtcccggctaccgaagtcctaggcctacgaactcaacgtccctcccgttcggacccataccgacgttcggggcccttaccggaacgggtcttacggggaggtaacgttacggggaacggtccgtacggtaaaccttaagtttacccgtaggtacccctaaagggtcccggttaaatacggaaccgtaaagggttaccggtaacccgttaaaaggttaaaacctcgtttacccggttaaccgtttaccggggtaaacgttacgggggaaaccccgtaaaacgggttccgaacccggtttcccggg

SEQ ID NO: 358756 - DNA, 539 bp, Homo sapiens
  misc_feature: GZ8MTXP02JE74J.9.34.D01.1.454.CMB.2.raw
  modified_base (249)..(249): a, c, t, g, unknown or other
  misc_feature (249)..(249): n is a, c, g, or t
  modified_base (357)..(357): a, c, t, g, unknown or other
  misc_feature (357)..(357): n is a, c, g, or t
  modified_base (472)..(472): a, c, t, g, unknown or other
  misc_feature (472)..(472): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccaganacaattcccagaacatactgtctctgcaactcaaataacctgagaggcgaggacacggccatttattctgtgcgaaggagcatatggaatacgatttcgatccctcgnagtcgacactttgattaacgtgggggcccggggaaccctggtccgccgtctcctcacgccctcaccaagggcccatcggtccttcccctggccaccctctaccaagacgcactcngggggcacgagccggccctgggctgccgtcgtacgaaggactaactccgaagtaccgatcactgagg

SEQ ID NO: 358757 - DNA, 756 bp, Homo sapiens
  misc_feature: GZ8MTXP02F2ULY.9.34.D01.1.454.CMB.2.raw
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacacgaccccaaagtcatcatttatgacaacatcgaacgccgccctcgacggggtcccctagacccgtacttccgtccggtacctaccgaaacggttccgtacgggaccaacctaacttcccgaaccggtcccccttaccccgttcgggacccctaacttcccgaaccgttcgggggcccttaccccgaacggggtcccgttacgggaaggggtaacgttggggaaacgggtcccgttagggtaaaccccgtttaattttaaacccgttcggaacccccgttaaagggtttcccgggttaaatttacgggaaacccgttaacggggttacgggttaacccccttaaaaagggtttaaaaccctcggttttaacccggttaaccgtttaaacccggggtaaaaccggtttaccgggggaaaaccccgtaaacgggttacccgtaaaccccgggtttaccccggg

SEQ ID NO: 358758 - DNA, 654 bp, Homo sapiens
  misc_feature: GZ8MTXP02J1RXQ.9.34.D01.1.454.CMB.2.raw
  modified_base (211)..(211): a, c, t, g, unknown or other
  misc_feature (211)..(211): n is a, c, g, or t
  modified_base (338)..(338): a, c, t, g, unknown or other
  misc_feature (338)..(338): n is a, c, g, or t
  modified_base (424)..(424): a, c, t, g, unknown or other
  misc_feature (424)..(424): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacaggtcctgggcccagtctgttctgacgcacgccgcctcagtgtctgggcccagggcagnggtcacatctcgtgcacgtggaagtacgctaccaacgagtcgggacacgttatgactgtaccacgtacgtaaccaactaaccttaccgacggaaccaccgaacccccaaagtccaatactaatttanacgtaacactataccggaacgccgcccgtacgacgggtacctgaccgtacttccgaccgctaccgaacgtcgtcgaccaacgtacnccgaacgtcccctacccgcggtaccacgtaccgacggtccggtctaccggaacggtcgtaggtaacgggagttacgggacgtctaacgttactacgttacgaccgtaccgtagtttacgtaaacgttgaaccgtaggtaaccggtaaaccttaacgtaaccgtaacgttcccgttaaggtacccggtaacgttacgggaaaccgtacggtacccggtacggttaccccgg

SEQ ID NO: 358759 - DNA, 660 bp, Homo sapiens
  misc_feature: GZ8MTXP02I29O7.9.34.D01.1.454.CMB.2.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtcgtcgtcggggccccagggccaggacgggtcaccgatctcgtgcacgtggaagtagctaccaaacagtcggggactacgttatgatagtacactagaaccaaacaacttccaaggaaccacgaccccaaagtcaactactattatcgaacaaacatacgaaacgccgtaccgtcgtacgggtccctgacccggtacttccgaccggtcctaccgtaaagtccgtaggaccaaacgtactaccgaacgtcccctaccgtacgaccctaattaccgaacgtcgggacctacccgaaggtcgtaggaggtactggaacggacctaggaacttaacggtttaaccgacgtacgtaagtacgtaacgtacgaaacgtacgttaacggtaaacgttaaaacgtaaccgtacgttacggttaacggttaacggtaaacggtacggaaaccgtaaccggtaccgtacccggtcg

SEQ ID NO: 358760 - DNA, 712 bp, Homo sapiens
  misc_feature: GZ8MTXP02HQ9JB.9.34.D01.1.454.CMB.2.raw
  modified_base (264)..(264): a, c, t, g, unknown or other
  misc_feature (264)..(264): n is a, c, g, or t
  modified_base (306)..(306): a, c, t, g, unknown or other
  misc_feature (306)..(306): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctggggggaggcttggtccagcctggggagtccctgcgactctcctgtgtggcctctggattcacctttgagacctatgccttgacctgggtccgccaggctccgaggggagggactgggagtgggtcgcaggcatcgctgggnggcggtcatgacacattcacgcaaactccgtggacggggccncttcatcatcctccgagacgaactaacttccccaagaaacctagtacctgtctctcgactaacctacaaattacctaggaggacggcgacggtaacgacggacctaatttttacttcgtagtcgacggaaaggaggactaagtaggtaggggtaaagttacgtaagttttccggacttccccgtcgactacgttccggaactttaaccgtttaggtacgtttacccggggacggggggaccccggggtaacccgttcggggttcccggtcccggttcctaccgtccgaccggtccctacccgaaacccggaaccggggtcccctacggtccccggtttcccccgtttcccccgtcgggtacccctacccccgttccgacccgaaaccggccgtacccgtaacccgg

SEQ ID NO: 358761 - DNA, 676 bp, Homo sapiens
  misc_feature: GZ8MTXP02HM32F.9.34.D01.1.454.CMB.2.raw
  modified_base (214)..(214): a, c, t, g, unknown or other
  misc_feature (214)..(214): n is a, c, g, or t
  modified_base (247)..(247): a, c, t, g, unknown or other
  misc_feature (247)..(247): n is a, c, g, or t
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
  modified_base (361)..(361): a, c, t, g, unknown or other
  misc_feature (361)..(361): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccnccaggctccgaggggaggactgggagtgggtcncaggcatcgctggtggcgtcatgacacatctacgcaaactccgtggacgggccnctcatcatcnccagagacaactcccagaactatactgtactctgacaacctacaataccngagacggacgacgacacggactactttattcgtggtacgaacggtagacgataagtagtagggtaacgttacgtactttaacgccttcccgtacgcctacgttaccactttacgttagtacgttaccggggtaccggggtacccgggtaccgtcgggtcccgtccgttaccgtccgtacgtaccgtacccgtacccgaaccggtaaacccgggtcccctaccggttcccggtttacccccttcccccggtaaccggtccccctaacccccgtttaccctaacccgtaacggaccccgtaacccgttacccccggg

SEQ ID NO: 358762 - DNA, 726 bp, Homo sapiens
  misc_feature: GZ8MTXP02GQUZ3.9.34.D01.1.454.CMB.2.raw
  modified_base (313)..(313): a, c, t, g, unknown or other
  misc_feature (313)..(313): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgagggggaggactgggaggtgggtcgcgaggcagtcgcgtgggtggcggtcatgacactattctacgacaaacgtccggtgacggggccncttcatcatctcagacacaacttaccaagaactatactgtactctgacctaacctacaaactaaccgtggaacggacgggacgtagggaccacgggtaccttaagtttttacttcgtggtacggacgaaagggtacggactaagtaggtaaggggtaaaacgttaccgttaattttaccggaaccttccccgtaccgtacgtaacgttaccggtaacttacgtttacgtaacgtttaccggggccgggggtaccccgggtaacccgttcggggtcccgtcccgttccgtcccgtcgacccggtcccctacccgaaacccggacgggtacccccttacgttccccggttccccgttacccccgtcggaccccctaccccgttaccccaccgaaaacgcccgtacctaccccggg

SEQ ID NO: 358763 - DNA, 588 bp, Homo sapiens
  misc_feature: GZ8MTXP02FLX18.9.34.D01.1.454.CMB.2.raw
  modified_base (237)..(237): a, c, t, g, unknown or other
  misc_feature (237)..(237): n is a, c, g, or t
  modified_base (325)..(325): a, c, t, g, unknown or other
  misc_feature (325)..(325): n is a, c, g, or t
  modified_base (369)..(369): a, c, t, g, unknown or other
  misc_feature (369)..(369): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactgggagtgggtcgcaggcatcgctgggtggcggtcatgacacattctacgcaaactccgtggacggggccncttcatcatctccagagacaattcccaagaacatactgtctctgacaactcaaataacctgagaggcgaggacacggctatttattcngtgacgaaggaggcagtagtagggaatacgtatttcgactcccncgcagtcactatttgattacggcgggggacccgggtaacctggtccgcgtctcctcacgcctaccaaccgacggacccagtccggtcctccccgtggccctacccctcctaccgaaacgtcacctaccgtcggcggggacacgacggccggtcccgtgggcctcggcctacgggtaccaacggtacctaaccgtcaacggtacctagtcacgtcgacgg

SEQ ID NO: 358764 - DNA, 642 bp, Homo sapiens
  misc_feature: GZ8MTXP02JST9G.9.34.D01.1.454.CMB.2.raw
  modified_base (262)..(262): a, c, t, g, unknown or other
  misc_feature (262)..(262): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctctcactctcctcgctcactgcacagggtcctgggcccagtctgttctgacgcacgccgcctcagtcgtcgtcgggggccccagggcaggacgggtccaccatcgtcgtgacacgtggaagtacgctaccaacgngtcggggctacggttatgatcgtacactacggtaaccaacaactccaaggaaccacgaccccaaagtcattcatttacagactaacgatcggaacgtcggaccgtccacggggtcccctgtacccgacgttcctcccggatcctaaggtcctaggctacgatcccacgcccgtaccccgtggtcccaacgtccgacgttccgggacttccgaggctaggtacgagtcggaggaccttagtacttacgtaccgtggtacccgtaagttccggtaatacgggtacgacggttaacggtaaccttaaacgtaacccgttacgttaccggtaaccgttacgggaaccgttacggggaacctaccggggtcctaaccgggtcccg

SEQ ID NO: 358765 - DNA, 578 bp, Homo sapiens
  misc_feature: GZ8MTXP02JKLZ1.9.34.D01.1.454.CMB.2.raw
  modified_base (368)..(368): a, c, t, g, unknown or other
  misc_feature (368)..(368): n is a, c, g, or t
  modified_base (469)..(469): a, c, t, g, unknown or other
  misc_feature (469)..(469): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
  modified_base (566)..(566): a, c, t, g, unknown or other
  misc_feature (566)..(566): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgacaactcaataacctgagaggcgaggacacggctatttattctgtgacgaaggagcatagtagggtaacgtacgtattttcgattccctcgcngtcgactactttgattacggcggggcccggggtaccctggtcccgtccgtctccctcgacgccctaccaaccgaacgggcccacgttccgtcccttccccnggccacccctacctaccaacgcgccctactcggcggggcacgcggccgccgngggcncgaccgtcgtacgacgtaccttaacgtccgacgtacgtancgacgtggacgg

SEQ ID NO: 358766 - DNA, 678 bp, Homo sapiens
  misc_feature: GZ8MTXP02JBXGB.9.34.D01.1.454.CMB.2.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgcctcagtgtcgtcggggccccagggcaggagggtcaccatctcgtgcacgtggaagtacgctaccaacgagtcggggacacgttatgatgtacacgtacggtaaccaactaacttaccaaggaaccaaccgacccccaaaagtccaacttactaattttacgagaacaaactagtacgaaacgccgaccctcggacgggtccctagaccgtacttccgtaccggtcctaccgtaagtccgtacggccacactaccacgtccccttacccgcggaccctactaccgacgtcgggcccttaccggacgggtcctagggtaacgggacgttagggacggtaccgttaggtaaacctttaatttaccgtaccggtaccggttaagttaccggttagttacggaacgttacgggtacggtaaacccttaaaagtaacctaggtttaccgtaacgtttacggaacgtacggggaacctaacggtccgtacccgttcgg

SEQ ID NO: 358767 - DNA, 691 bp, Homo sapiens
  misc_feature: GZ8MTXP02F86TN.9.34.D01.1.454.CMB.2.raw
  modified_base (312)..(312): a, c, t, g, unknown or other
  misc_feature (312)..(312): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctggggggaggcttggtccagcctggggagtccctgcgactctcctgtgtggcctctggattcacctttgagacctatgccttgacctgggtccgccaggctccgagggggaggactgggagtgggtcgcgaggcagtcgcgtgggtggcggtcatgacacattcaacgcaaacgtccggtggacggggccncttcatcatcctaccaagacaacctaactaccccaagaacattactgtctctagaccaacctaccaaaactacctggaagacggcgacggacacggtaccttattttactttcgtgtcggaacggtaagggaggactaagtaggtaggggtaaagttacggttaacttttccgaccttacccgtccgactacggtaccgtactttacggttttcgggttaacgggtaccgggggtacccccgggtaccgttcggggtcccgtaccgttccctcccgtcgaccgtcccctaccgaaacccggaccgggcccttacgtcccggttacccctccccggtcgaaccctaccccgtcctaccgaacgtccgaccaccgtcgggg

SEQ ID NO: 358768 - DNA, 618 bp, Homo sapiens
  misc_feature: GZ8MTXP02GC44C.9.34.D01.1.454.CMB.2.raw
  modified_base (232)..(232): a, c, t, g, unknown or other
  misc_feature (232)..(232): n is a, c, g, or t
  modified_base (367)..(367): a, c, t, g, unknown or other
  misc_feature (367)..(367): n is a, c, g, or t
  modified_base (387)..(387): a, c, t, g, unknown or other
  misc_feature (387)..(387): n is a, c, g, or t
  modified_base (467)..(467): a, c, t, g, unknown or other
  misc_feature (467)..(467): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccaagaacatactgtctctgcaactcaaataacctgagaggcgaggacacggccattttattctgtgcgaaggagcatagtaggaagtacgtattttcgactccctccgcngtcactactttgattacggngggggcccgggtaacctggtcgccgtctcctcacgccctccgaaccgaaacgggccctaacgtccggtcccttcccccgnggcccacccctcctaccaacgacgcacccgtcgtcgggggacaacgcggcccggcccgttggggcctcggcccgttagggtaacccgtaaacgggtaccttaaccgtttacccgaaggtacccgttaaccgaccgttaggacggcccgggg

SEQ ID NO: 358769 - DNA, 668 bp, Homo sapiens
  misc_feature: GZ8MTXP02GRUAJ.9.34.D01.1.454.CMB.2.raw
  modified_base (478)..(478): a, c, t, g, unknown or other
  misc_feature (478)..(478): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctggggggaggcttggtccagcctggggagtccctgcgactctcctgtgtggcctctggattcacctttgagacctatgccttgacctgggtccgccaggctccgagggggagggactgggagtgggtcgcgaggcatcgcgtgggtggcggtcatgacacattctacgacaaactccggtaggacggggcccgtcttcaatcaacttcctacccaagacgaactaaacttaccccaaagaaacatacttgtcctctcgactaaccctacaaactaacctggagaggacgaggaccacggcctatttattctgtagacgaaggagcaagtagagggtaatacgtactttcgactcccncgactacgtccgacttacgttagtacgttacgggacgggggacccggggtaacccgtcgggtacccgtccgttccgtccctcgaccgtccctaccgaaacccggaccggtccctacgttcccggtccccgttcccccgcggtaccccctaaccccgttcccgaccgaacgtaccgacccgttaccccggg

SEQ ID NO: 358770 - DNA, 615 bp, Homo sapiens
  misc_feature: GZ8MTXP02F9Y50.9.34.D01.1.454.CMB.2.raw
  modified_base (370)..(370): a, c, t, g, unknown or other
  misc_feature (370)..(370): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccgcttcatcatctccagagacaacttcccaagaacatactgtctctgcaactcaaataacctgagaggcgaggacacggcctatttattctgtgcgaaaggagctaatagtgggaagtacgtatttcgactccctcgcngtcgaactcgtttgattacggtcgggggacccgggtaacccgttgggtcccgtcccggttactccctacgacgtcccctaccgaacccgaacgggcccctaagtcccggttccccttccccgtcggccctaccccgtccctacccgaacgacgcccaccgtcggtcggggaccacgacggccggcccgtgggctcgccgtgtacaacggtacctaacgttcgaacgtacgtctacactggaccgg

SEQ ID NO: 358771 - DNA, 656 bp, Homo sapiens
  misc_feature: GZ8MTXP02F8FY0.9.34.D01.1.454.CMB.2.raw
  modified_base (336)..(336): a, c, t, g, unknown or other
  misc_feature (336)..(336): n is a, c, g, or t
  modified_base (378)..(378): a, c, t, g, unknown or other
  misc_feature (378)..(378): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgcctcagtgtcgtcggggccccagggcaggagggtcaccatctcgtgcacgtggaagtacgctaccaacagtcggggactacggttatgatcgtacactacgtaaccaacactccaaggaaccaccgacccctaaagtcaatactatttanagacaaacatacgaagccgcctacgacgggtcccagaccgtnttccgtccgcctaccaagtctcgaccacactccacgcccttcccgtcggccctaagtcccacgtacgggccttacccggacggtcctagggaggtacgtacgggacgtaccgttacggtaacctttaacgttaaccgcgtaccgtaacggttccgtaagtacgtacggtacggtacggtaacccttaaagggtaaacctacgtttaccgttaaccgtttaaaccggaaccggttacgggtaaacccgtaacgggtaccgtaacccggtttacccgggg

SEQ ID NO: 358772 - DNA, 596 bp, Homo sapiens
  misc_feature: GZ8MTXP02HV4UG.9.34.D01.1.454.CMB.2.raw
  modified_base (214)..(214): a, c, t, g, unknown or other
  misc_feature (214)..(214): n is a, c, g, or t
  modified_base (245)..(245): a, c, t, g, unknown or other
  misc_feature (245)..(245): n is a, c, g, or t
  modified_base (301)..(301): a, c, t, g, unknown or other
  misc_feature (301)..(301): n is a, c, g, or t
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccnccaggctccaggggaggactggagtgggtcncaggcatcgctggtggcggtcatgacacattctacgcaaaactccgtgaggggccncttcaatcatctcagagacaattccccagaaacatactgtctctgacaactcaaataacctgagagcaggacacggcaatttatttcngtgacgaaggaganagtagtaggtaatacgtatttcgactcctcactagtacgactacgttgacgttacgcggggacccggtaccgtggtccgccgtactccgtacgacgaccctacccgaaccgaaaccgggaccctacgtacccggttcccttcccccgtcgtaccctaccccttccgtaacccgtaaacgaccgacccgtaccg

SEQ ID NO: 358773 - DNA, 728 bp, Homo sapiens
  misc_feature: GZ8MTXP02ICE0X.9.34.D01.1.454.CMB.2.raw
  modified_base (191)..(191): a, c, t, g, unknown or other
  misc_feature (191)..(191): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctnagtgtcgtggggccccagggcagagggtcaccatctcgtgcacgtggaagtagctaccaacgagtcggggacacgttatgatgtacacgtacggtaccaacaacttccaggaaccacgaccccaaagtcacgtactattatacgaacaactagtacgaaacgccgtacccgtacggacggggttcccctacggacccgtacgtttccgcccgggtacctacccgtaaagtccgtacggacctacgactaccgtacgtccccgtacccgtcggaccctacgtaccgaaccggttcgggccttacccggaacgggtcccgttagggaacgggtacgttacgggaacgggtaccgttacggtaaacttacgttaaaccgttcgacccgtaacggttacccgttaaagtacgtaaaccggtaacggttaccgggtaaacccttaaaacggttaaacgtaccgttaccggttaaccggtttaccgggaaaccgtttaccggggaaaccctaaccggggtacctaaccccgggtttacccggg

SEQ ID NO: 358774 - DNA, 710 bp, Homo sapiens
  misc_feature: GZ8MTXP02HHFFA.9.34.D01.1.454.CMB.2.raw
  modified_base (194)..(194): a, c, t, g, unknown or other
  misc_feature (194)..(194): n is a, c, g, or t
  modified_base (230)..(230): a, c, t, g, unknown or other
  misc_feature (230)..(230): n is a, c, g, or t
  modified_base (358)..(358): a, c, t, g, unknown or other
  misc_feature (358)..(358): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagttctgttctgacgcacgcccgccctnagtgtccgtcggggcccaggggcaggagggtcaccntcctcgtgctacgtaggaacgtacgcctaccaacgacggtccggggactacggttatgactgtacacgtacggtaacccaactaacttaccgaacggaaccaccgaccccaaagtcactactatttanacgtaacaacgtagtacgaaccggccgacccgtcggtacgggtcccctagacccgttcttccgcccggcctaaccgtacggtcgtacggactacactccaccgtcccttcccgcggtcccaacgtccgtacggtccggtacctcgacggtcgtaggggaagtaccgtagggacgtctaacggtaccttaagttaccgtcggacccgtaggttccgttaagaccgtacggtaacggttacggtaacccttaaaacgtaaaccgttcgtttacccgggttaaccgtttaaccgggtaaccggttacggggtaaaccccgtaaacggggtttaaccccgtcggtttaacccgggg

SEQ ID NO: 358775 - DNA, 728 bp, Homo sapiens
  misc_feature: GZ8MTXP02IMZN7.9.34.D01.1.454.CMB.2.raw
  modified_base (145)..(145): a, c, t, g, unknown or other
  misc_feature (145)..(145): n is a, c, g, or t
  modified_base (234)..(234): a, c, t, g, unknown or other
  misc_feature (234)..(234): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccnccaggctccgaggggagggactggagtgggtcgcagacatcgctggtggcggtcatgacacattctacgcaaactccgtggaggggccncttcatcatctcagagactaacttcccaagaacattactgtctctgacaactcaaataacctgaaggaggacgaggaccacggcctaattttattcgaggtgacggtaaggacggcaagtaggtaggggtaaactacgtattttccgaattccccgtacgactacgggtcaacttacgtttgaacgtttaccggcgggggaaccccgggtaaccgttcgggaccgtcccgtcgtccctcacgtccctaccaaccgaaacgggtcccctaacgttcccgggttccccttacccccgtcgggtacccctaccccgttacccaccgtaacgaccgtacccaaccggttcgggtccgggggacctacccgaacgggttccccgggcccggttacggggtcccgtaccggtccggttacggggtaaccgtaaaacggtaccgttaacccgttaccgaaaacggttacctacgttacccgaaacggttacggaccggggg

SEQ ID NO: 358776 - DNA, 749 bp, Homo sapiens
  misc_feature: GZ8MTXP02JGUX9.9.34.D01.1.454.CMB.2.raw
  modified_base (234)..(234): a, c, t, g, unknown or other
  misc_feature (234)..(234): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgacggggccncttcatcatctccagagacaactcccagaacatactgtctctgcaactcaaactaacctgaaggaggacgaggacacggtcctaattttcttctggtgacggtaaggagactaagtaggtagggaacgttacgtagtttttaccgacttccccgtaccgactacgggtacctaacttaacgttttgaacgtttaccgggtacggggggaccccggggttaaacccgttgggtcccggtcccgttccttcccgtacgaccggtccccctaccgaaacccggtaacggggccccctaggttccccgggttcccctttccccccggacgggtccccctaaccccctttcccgaacccgaaaacggccgacccgttaccccgttcgggggtcgggggaacccaaaccggcgggcccccggggtccgtcgggggtcccctaccgggtccggtacggtaaccgtaacggttacccttaaccgtacggaacggtaccgttacgaccgtaacggcgggaccgg

SEQ ID NO: 358777 - DNA, 652 bp, Homo sapiens
  misc_feature: GZ8MTXP02JM18N.9.34.D01.1.454.CMB.2.raw
  modified_base (335)..(335): a, c, t, g, unknown or other
  misc_feature (335)..(335): n is a, c, g, or t
  modified_base (467)..(467): a, c, t, g, unknown or other
  misc_feature (467)..(467): n is a, c, g, or t
tcagtgatacgtctcacgaccggtgctcgatttagatcgtctgtggttggggtttgggggaggcttggtccagcctggggagtccctgcgactctcctgtgtggcctctggattcacctttgagacctatgccttgacctgggtccgccaggctccgaggggagggactgggagtgggtcgcagacatcgctggtggcggtcatgacacattctacgcaaactccgtggacggggccgtcttcatcatctccagagacaacttcccaagaacatactgtcctctgacaactacaaacgtaacctgaagaggcgaggacacggcctaatttattcngtgacggaaggcgctagtagtgggaaacgtcgtatttcgactcccgtccgctaggtacgactactttagaacgttccgggtacgggggacccggggtaaccgtcggtaccggcccgtccgtccgtacgaccnccctaccgaccgaacgggccctacgtccggtcccttccccgtcggccctacccgtcctaccgaacgccgccgtaccgtcggcgggggacacggaccggtccggcccggtcgggcctcggtccgtcggaccgtaacggtaccttaaccgtacccgaacggtactaacgtccgacggtggtcccggg

SEQ ID NO: 358778 - DNA, 666 bp, Homo sapiens
  misc_feature: GZ8MTXP02I8QBC.9.34.D01.1.454.CMB.2.raw
  modified_base (241)..(241): a, c, t, g, unknown or other
  misc_feature (241)..(241): n is a, c, g, or t
  modified_base (342)..(342): a, c, t, g, unknown or other
  misc_feature (342)..(342): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctccctctcctcctcactctcctcgctcactgcacagggtcctgggcccagtctgttctgacgcacgcccgccctcgagtcgtccgtcgggggccccagggccagacgggtcaccatctcgtncagtgagtagctcaatagcgggctacgtatgatcgtacactacgtaccaacaacttccgaaggacaccgacccccaaagtcactctatttatagaaccaanatacgaacgccgccctcgacgggtccccngccgtntccgtccggactccgaagtccgtggacacgactcgacgtccctccgtggacccctagtcctacgtcgggcctaacccggaggtacgtaggacggtagtacgggtaaccgtccgttacggtaacctttacgttaccgccggtaacccgtacggtttaacgtaacgtaccggtaacgtaaccgggtacggtaaaccgttaaaacgttaaccgtaccgtttaccgtaacccggttaaccgggtaaaccggtaccgggtaaccggttaaaccggtacccgtaacccggtacgg

SEQ ID NO: 358779 - DNA, 600 bp, Homo sapiens
  misc_feature: GZ8MTXP02FM85N.9.34.D01.1.454.CMB.2.raw
  modified_base (369)..(369): a, c, t, g, unknown or other
  misc_feature (369)..(369): n is a, c, g, or t
  modified_base (468)..(468): a, c, t, g, unknown or other
  misc_feature (468)..(468): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattcacgcaaactccgtgaggggccgcttcatcatctccagagacaattcccaagaacatactgtctctgcaaactcaaataacctgaagaggcgaggacacggctatttattctgtgcgaaaggagcatagtgggaaacgtacgtatttcgatccccctcgcncgtcgactactttgatttacgcgggggacccggggaaccctggtccgcccgtctctcacgccctccgaccgaacggcccagttccggtcccttcccccncggcccaccccttcccaccaacgacgccacctcggtcggggaccacgacgccggccctgggggcctcggccctcggtaaccgaacggtaccctaacgttacccaacggtaccgtactacaccgtgaccgggg

SEQ ID NO: 358780 - DNA, 607 bp, Homo sapiens
  misc_feature: GZ8MTXP02FGRYC.9.34.D01.1.454.CMB.2.raw
  modified_base (275)..(275): a, c, t, g, unknown or other
  misc_feature (275)..(275): n is a, c, g, or t
  modified_base (339)..(339): a, c, t, g, unknown or other
  misc_feature (339)..(339): n is a, c, g, or t
  modified_base (486)..(486): a, c, t, g, unknown or other
  misc_feature (486)..(486): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagcccgccctcagtgtcgtcggggccccagggcaggagggtcaccattcctcgtgacacgtggaagtagctaccaacacgtcggggcacgttangatcgtacacgtggtaaccaaactaacttaccaaggaacacgacccccaaagtcatcaatttangaacaaacatagaacgccgcctacgacggggtccctagaccgacttcgtccggacctaccaagtctggaccacactacacgccctcccgtcggaccaatccacgtcgggcctaccgaggctggaggataggagctagacttattacncgaccgtagtacgtagtagaccgtaggtacggtaaccctaaagtaacctacgttacggtaaccgtttacggaaaccggttacggggaaaccgtaacgggtacccgtaccggtttacccggg

SEQ ID NO: 358781 - DNA, 633 bp, Homo sapiens
  misc_feature: GZ8MTXP02HR2T0.9.34.D01.1.454.CMB.2.raw
  modified_base (226)..(226): a, c, t, g, unknown or other
  misc_feature (226)..(226): n is a, c, g, or t
  modified_base (346)..(346): a, c, t, g, unknown or other
  misc_feature (346)..(346): n is a, c, g, or t
  modified_base (408)..(408): a, c, t, g, unknown or other
  misc_feature (408)..(408): n is a, c, g, or t
  modified_base (437)..(437): a, c, t, g, unknown or other
  misc_feature (437)..(437): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacgagggtcctgggcccagtctgttctgacgcacgccgcctcagtgtcgtcggggcccagggcagacgggtcaccntctcgtgcacgtggaacgtacgctaccaacgacggtcggggactacgttatgatgtacacgtacgtaaccaactaacttccgaaggaaccaccgacccccaaaagtcaactactatttanacgaacaagatacgaacgccgcctcggacggtcccacgtccgactccgtccgctacacgtcncgcacatcacgtccctcccgtcgcctacnccacgtcggcctacggagcgtaggagtacgtggacggtctacggttaacttacgttacgtccgtaccgtacgtaccgttagtacggtaactacggtaacggtaaccgttaaaacgtaccttacgttaccggttaaccggtttaaccggaaccggttaccgggaaaccggtaccggtacccgttaacccggtcccgg

SEQ ID NO: 358782 - DNA, 560 bp, Homo sapiens
  misc_feature: GZ8MTXP02JNKM4.9.34.D01.1.454.CMB.2.raw
  modified_base (276)..(276): a, c, t, g, unknown or other
  misc_feature (276)..(276): n is a, c, g, or t
  modified_base (321)..(321): a, c, t, g, unknown or other
  misc_feature (321)..(321): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (364)..(365): a, c, t, g, unknown or other
  misc_feature (364)..(365): n is a, c, g, or t
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (548)..(548): a, c, t, g, unknown or other
  misc_feature (548)..(548): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaacttcccaagtaacatactgtccnctgcaactcaataacctgacgaggcgagacacggctatttattcngtgcgaaggngcatgngggaactcgtatttcgactcccgacgnngtcactgttnatcgtgggcccggacctggtcnccgtntccgtcacgccctaccaccgaacggtcccacgttccggtccccttccctcggccacccctccaccaacgcgccaccgtgcggggacacgtcgcggtcccgtggcctgaccctggtacaacggtactaaccgttacacgtacctacncgtacgacggcg

SEQ ID NO: 358783 - DNA, 694 bp, Homo sapiens
  misc_feature: GZ8MTXP02GWK9O.9.34.D01.1.454.CMB.2.raw
  modified_base (261)..(261): a, c, t, g, unknown or other
  misc_feature (261)..(261): n is a, c, g, or t
  modified_base (368)..(368): a, c, t, g, unknown or other
  misc_feature (368)..(368): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggaggactggagtgggtcgcaggcatcgctggtggcggtcatgacacattctacgcaaactcgtgagggccgcttcatcatctccagagacaattcccagaacntactgtactctgcaactcaataacctgagaggcgaggacacggcctagtttatttcagtgacgaaggaggcatatagggaacgtacgattttcgacttccctcgacngtcgactactttgactttacgtcgggggacccggggtaaaccctgggttccgacccgttccgtccgttacacggccccttaccaaccgtaacggggccctacgtccggttccttacccccgtcggcctaaccccccgttctaaccccgaaaacgtaccgtcccgaaccctttacggtccggggggaccaccgttaacgggtccccgggcccccggtttggggaaacccgtttccggaccccgttgggttaaccgaaaacccgggggttaaaaccttccgttaccccgaaagggtacccgttaaaccgtacgtaccgtacggtacgg

SEQ ID NO: 358784 - DNA, 586 bp, Homo sapiens
  misc_feature: GZ8MTXP02FZNIP.9.34.D01.1.454.CMB.2.raw
  modified_base (575)..(577): a, c, t, g, unknown or other
  misc_feature (575)..(577): n is a, c, g, or t
  modified_base (579)..(583): a, c, t, g, unknown or other
  misc_feature (579)..(583): n is a, c, g, or t
  modified_base (585)..(586): a, c, t, g, unknown or other
  misc_feature (585)..(586): n is a, c, g, or t
tcagtgatacgtctcacgaccggtgctcgatttagatcgtctgtgttgggtttgggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggcctattttattctgtgacgaaaggaggcaatagtgggaaagtacgtattttcgactcccctcgcagtcgactactttgacttacggtcggggaccgggacctggtccgccccgtctcctcacgccctaccaccgacgggcccacgtccggtccctcccccgtggccctaccctccctaccgaaacgcgccaccgtcgtacgggggccacgacgcccggccgtgggcctcgccgtcggtaccaacgggtaccttaccgttacccgagtacgtacgtccacgtcggacggccgggcgtcgggacgacgggccgacgaacgacgnnngnnnnncnn

SEQ ID NO: 358785 - DNA, 569 bp, Homo sapiens
  misc_feature: GZ8MTXP02I08SJ.9.34.D01.1.454.CMB.2.raw
  modified_base (232)..(232): a, c, t, g, unknown or other
  misc_feature (232)..(232): n is a, c, g, or t
  modified_base (329)..(329): a, c, t, g, unknown or other
  misc_feature (329)..(329): n is a, c, g, or t
  modified_base (388)..(388): a, c, t, g, unknown or other
  misc_feature (388)..(388): n is a, c, g, or t
  modified_base (481)..(481): a, c, t, g, unknown or other
  misc_feature (481)..(481): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggaatgggtcgcaggcatcgctggtggcggtcatgacacattctacgcaaactccgtgaggggccncttcatcatctccagagacaattcccaagaacatactgtctctgcaactcaataacctgagaggcgaggacacggcctatttattctgtgcgaaggnggcatagtggaacgtacgtattttcgactccctccgcagtcgactactttgattacggngggggcccgggacctggtcgcccgtctcctcacgccctcgaccgacgggcccagtccggtcccttccccgcggccacccctcctaccaacgcnccaccgtcggtggggccacgcggccggccgtggctcgccgtcggacgaacggaccttaaccgtccgaagtacgtactcgacgtgacgg

SEQ ID NO: 358786 - DNA, 828 bp, Homo sapiens
  misc_feature: GZ8MTXP02IY96M.9.34.D01.1.454.CMB.2.raw
  modified_base (234)..(234): a, c, t, g, unknown or other
  misc_feature (234)..(234): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgacggggccncttcatcatctccagagactaattcccaagaacatactgtacctctgcaactacaactaccgtgagaggacgaggaccacggaccttaattttactttcgtggttaggacggtaaagggaggtactaagtagtaggggtaaacgttacgtattttaccgacttccccgtacgactacgggtcctaacttaccgttttagacgtttacggggcgggggtaccccggggtaaacccttcggggtcccgtcccggttacctccccgttacgaccggttccccctaacccgaaacccggtaaaccggggtcccctacggtttccccgggttacccctttaccccccggtcgggtaacccctaccccccttacccgttaacccgaaaacggcccgtacccgtaaccccggtttcggggtaccggggggaacccctaaaccgggaccggggtcccccgggggtcccccgggttcgggggtaacccgttacgggacccccggtttagggaaccccggtaaaacggggttaccccttaaacccgtttaccggaaaccggttaccggttaccttaccggaaccggtttcgggaaacccggggg

SEQ ID NO: 358787 - DNA, 618 bp, Homo sapiens
  misc_feature: GZ8MTXP02G5T9D.9.34.D01.1.454.CMB.2.raw
  modified_base (251)..(251): a, c, t, g, unknown or other
  misc_feature (251)..(251): n is a, c, g, or t
  modified_base (311)..(311): a, c, t, g, unknown or other
  misc_feature (311)..(311): n is a, c, g, or t
  modified_base (426)..(426): a, c, t, g, unknown or other
  misc_feature (426)..(426): n is a, c, g, or t
  modified_base (535)..(535): a, c, t, g, unknown or other
  misc_feature (535)..(535): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctggggggaggcttggtccagcctggggagtccctgcgactctcctgtgtggcctctggattcacctttgagacctatgccttgacctgggtccgccaggctccgagggggagggactgggagtggggtcncgaggcatcgcgtgggtggcggtcagtgacacattctacgcaaactccgtgacggggccncttcatcatctccagagacaattccccaagaacatactgtctctgacaacctcaaactaaccgtgaacgaggcgacggtacaacggtcctaagttttattcgtgtgacgaagggngacatagtagggaagtacgtattttacgactccccgtacgcacgtacgacttacgtttgtagtttacggcgggggacccgggtacccttgggtcccgccgtccgtcccncgtaccgccctaccgaaccggaccggaccctacgttcccgtcccttcccgcgtcccctacccgtcctacacgcgaccgtaccg

SEQ ID NO: 358788 - DNA, 621 bp, Homo sapiens
  misc_feature: GZ8MTXP02H19RZ.9.34.D01.1.454.CMB.2.raw
  modified_base (230)..(230): a, c, t, g, unknown or other
  misc_feature (230)..(230): n is a, c, g, or t
  modified_base (246)..(246): a, c, t, g, unknown or other
  misc_feature (246)..(246): n is a, c, g, or t
  modified_base (326)..(326): a, c, t, g, unknown or other
  misc_feature (326)..(326): n is a, c, g, or t
tcagtgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccgaggggaggactggagtgggtcgcaggcatcgctggtggcggtcatgacacattctacgcaaactcgtgaggggccncttcatcatctcaganacaattcccagaacatactgtctctgacaaactcaataacctgagaggcgaggacacggcaatttattctgtgcgaaggngtcatagtaggaacgtacgtatttcgattccctacgcagttcgactattttgaactttacggcggggacccggggtaacctcggtccgtcccgtcgtcccgcctacgaccctaccgaaccgaacggggcccagtcccggttccttcccccgtggtcccacccctacctacccgaagaacgcctaacccgtcgtcgggggccacgaacggcccgggacccgttcggggaccttcggccgttcggaccgaacggacctaaccgttccgaacgtaccgtaataccgacgtacgacggg

SEQ ID NO: 358789 - DNA, 633 bp, Homo sapiens
  misc_feature: GZ8MTXP02GX7N7.9.34.D01.1.454.CMB.2.raw
  modified_base (252)..(252): a, c, t, g, unknown or other
  misc_feature (252)..(252): n is a, c, g, or t
  modified_base (321)..(321): a, c, t, g, unknown or other
  misc_feature (321)..(321): n is a, c, g, or t
  modified_base (617)..(617): a, c, t, g, unknown or other
  misc_feature (617)..(617): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcgaggcatcgcgtggtggcggtcatgacacattctacgacaaactccgtgaggggccgcttcatcatctcaganacaatcccagaacatactgtctctgacaactcaaatacctagagaggcgaggacacggctatttattcngtgacgaaggagacagtagtaggaagtacgtatttcgactccctcgctcgtcgactacgtttagattacggtcgggggacccggggaacccgtcggtccgtcccgtctcctcgacgccctaccgaacccgtaacgggcccctacgttccgggttcccttcccccgtcggtaccctaccccttcccaccgaacgaccgacctacccgtcggtacgggggacaacgacggcccggcccggtcgggcctcggtccgtacggtaccgtaacggtactaaccgttaccgacgtacgttacncctaacgtggaacggg

SEQ ID NO: 358790 - DNA, 624 bp, Homo sapiens
  misc_feature: GZ8MTXP02HZ867.9.34.D01.1.454.CMB.2.raw
  modified_base (234)..(234): a, c, t, g, unknown or other
  misc_feature (234)..(234): n is a, c, g, or t
  modified_base (249)..(249): a, c, t, g, unknown or other
  misc_feature (249)..(249): n is a, c, g, or t
  modified_base (275)..(275): a, c, t, g, unknown or other
  misc_feature (275)..(275): n is a, c, g, or t
  modified_base (333)..(333): a, c, t, g, unknown or other
  misc_feature (333)..(333): n is a, c, g, or t
  modified_base (373)..(373): a, c, t, g, unknown or other
  misc_feature (373)..(373): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactgggagtgggtcgcaggcatcgctggtggcggtcatgacacattctacgcaaactccgtgaggggccnttcatcatctcaganacaattcccaagaacatactgtctcngcaaactcaaataacctgagaggcaaggacacggcctatttatttctgtgacgaaggnggacagtataggggaatacgtatttcgacttcccgtccgntacgtcaactacgttttgaactttcggacgggggacccggggtaaacccgtggtcccgtcccgtcctcccgtccacgtccctcccaaccggaccgggccctacgtccggttcccttccccgtggtccctacccctcctaacccagacgaccctacgtcggtcggggcacgacgccggtcctgggcctcggccttacgggacctaaacggaccttaaccgttaccgacgtacgtactaccgacgtagcgggg

SEQ ID NO: 358791 - DNA, 662 bp, Homo sapiens
  misc_feature: GZ8MTXP02HCBB6.9.34.D01.1.454.CMB.2.raw
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
  modified_base (485)..(485): a, c, t, g, unknown or other
  misc_feature (485)..(485): n is a, c, g, or t
  modified_base (607)..(607): a, c, t, g, unknown or other
  misc_feature (607)..(607): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggagggactggagtgggtcgcaggcatcgctggtggcggtcatgacacattctacgcaaactccgtggaggggccncttcatcatctccaganactaatcccaagaacatactgtctctgactaacctacaaactaacctgaaggaggaccggaaggaaccgaccggaccttaattttactttcgtggtacggacggtaaagggaggactaagtaggtaggggaaacgttacgttatttttcgacttccccgtccgactcgtaccgtactacgtttgacgtttacgggcgggggtacccgggtaccgtggtcccgtccgtcctccncgtaccgccctacccgaaccgtaacgggccctacgttcccggtccccttcccccgtcgacccctcccctaccgtaccaacgccaccgtaccgtcgggcggggaccacggcggccggtcccgnggcctcggccgtacgacgacggtactccgtcgacgactacgtacacggtcgacgg

SEQ ID NO: 358792 - DNA, 605 bp, Homo sapiens
  misc_feature: GZ8MTXP02F45BN.9.34.D01.1.454.CMB.2.raw
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggagggactgggagtgggtcgcaggcatcgctgggtggcggtcatgacacattctacgcaaactccgtggacgggccncttcatcatctccaganacaacttcccaagaacattactgtctctgacaaactacaaataacctgagaggcgaaggacacggcctattttattcgtgtgacggaaggaggctaagtaggtaggggtaaacgtacgttattttcgacttccccgtcgctgtccaactacgtttagagttacggcgggggacccgggtaccgtcggtccgtccgtctcctcacgccctacgaccgacggccagtccgtccctcccgtcggcctaccctcctaccgaacgcgaccaccgtcggcggggacacgacggccggccgtgggctcgccgtacggtacgaacgaccttcgtaccagtacgtacacgacgtggacgg

SEQ ID NO: 358793 - DNA, 581 bp, Homo sapiens
  misc_feature: GZ8MTXP02I7G06.9.34.D01.1.454.CMB.2.raw
  modified_base (145)..(145): a, c, t, g, unknown or other
  misc_feature (145)..(145): n is a, c, g, or t
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (263)..(263): a, c, t, g, unknown or other
  misc_feature (263)..(263): n is a, c, g, or t
  modified_base (315)..(315): a, c, t, g, unknown or other
  misc_feature (315)..(315): n is a, c, g, or t
  modified_base (367)..(367): a, c, t, g, unknown or other
  misc_feature (367)..(367): n is a, c, g, or t
  modified_base (389)..(389): a, c, t, g, unknown or other
  misc_feature (389)..(389): n is a, c, g, or t
  modified_base (415)..(415): a, c, t, g, unknown or other
  misc_feature (415)..(415): n is a, c, g, or t
  modified_base (471)..(471): a, c, t, g, unknown or other
  misc_feature (471)..(471): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccnccaggctccaggggagggactggagtgggtcgcaggcatcgctggtggcggtcatgacanattctacgcaaactccgtgagggccnttcatcatctccagagacaactcccaagaacntactgtctctgcaactcaatacctgagaggcaggacacggctatttacttcngtgacgaaggacgctagtagtagggaactacgtatttcgacttcccgacgcnggtccactacgttgattcgggnggggcccggggtaaacctcgggtccnccggttctccgtcgacgtcctaccgaaccgacgggcctagtccggtccttccccgngtccctaccctcctaccagcgccaccgtggtcggggcacgacggtccgccgtggcctcgcgttggaccaaggtacctaaccgttacgacgtacgtactcacgtcgacggg

SEQ ID NO: 358794 - DNA, 690 bp, Homo sapiens
  misc_feature: GZ8MTXP02JPZ87.9.34.D01.1.454.CMB.2.raw
  modified_base (145)..(145): a, c, t, g, unknown or other
  misc_feature (145)..(145): n is a, c, g, or t
  modified_base (233)..(233): a, c, t, g, unknown or other
  misc_feature (233)..(233): n is a, c, g, or t
  modified_base (249)..(249): a, c, t, g, unknown or other
  misc_feature (249)..(249): n is a, c, g, or t
  modified_base (264)..(264): a, c, t, g, unknown or other
  misc_feature (264)..(264): n is a, c, g, or t
  modified_base (624)..(624): a, c, t, g, unknown or other
  misc_feature (624)..(624): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccnccaggctccgaggggagggactggagtgggtcgcaggcatcgctggtggcggtcatgacacattcaacgcaaactccgtgaggggccncttcatcatctcaganacaattcccagaacntactgtctctagcctaactcgaataaccgtgacgagggcgacggaaccacggccttagtttactttcgtggtagacggtaaggacggacaagtacgtaggggtaaactacgttaacttttcgactcccgtcgacgtacgtccgaacttacgtttagtagttaccggtcgggggtaccccggggtaaacccgttcggggtacccgtcccggttcctcccgttaccgaccgtcccccgtaccaaacccggacgggacccctacggtttcccgtacccccgttttcccccgcgtaccccctaccccgtacccctaccgaacgtaacgccctaccgtccggcggggccaacgcggccgtccggnggaccgtcgccgttacgaccgaacggtacctaaccgtcgaacgtacgtactaccgacgtcgacggg

SEQ ID NO: 358795 - DNA, 604 bp, Homo sapiens
  misc_feature: GZ8MTXP02GUOWG.9.34.D01.1.454.CMB.2.raw
  modified_base (234)..(234): a, c, t, g, unknown or other
  misc_feature (234)..(234): n is a, c, g, or t
  modified_base (264)..(264): a, c, t, g, unknown or other
  misc_feature (264)..(264): n is a, c, g, or t
  modified_base (330)..(330): a, c, t, g, unknown or other
  misc_feature (330)..(330): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (391)..(391): a, c, t, g, unknown or other
  misc_feature (391)..(391): n is a, c, g, or t
  modified_base (589)..(589): a, c, t, g, unknown or other
  misc_feature (589)..(589): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactgggagtgggtcgcaggcatcgctgggtggcggtcatgacacattctacgcaaactccgtgaggggccncttcatcatctccagagacatcccagaacntactgtctctgcaaactcaaataacctgagaggcgaggacacggctatttattctgtgacgaaggnggcagtagtaggaagtacgtattttcgacttcccnccgcngtccgactatttgattacggngggggcccggaaccctgggtccgcgtctccgtcacgtcctaccaccgtaagggccctacgtccggttcccttcccccgtaggtcccaccccttccacccgaaacgactccgaacccgttcggcgggggacacgccggtccgcccggttgggcctacgcccgtacggtacaacggtacctaacgttcccaggtaacttnaccgacgtacgcggg

SEQ ID NO: 358796 - DNA, 623 bp, Homo sapiens
  misc_feature: GZ8MTXP02GX9BQ.9.34.D01.1.454.CMB.2.raw
  modified_base (313)..(313): a, c, t, g, unknown or other
  misc_feature (313)..(313): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctggggggaggcttggtccagcctggggagtccctgcgactctcctgtgtggcctctggattcacctttgagacctatgccttgacctgggtccgccaggcctccgagggggagggactgggagtgggtcgcgaggcatcgctgggtggcggtcagtgacacattctacgacaaacgtccgtggacggggccncttcatcatctaccagacgactaatcccaagaacatactgtctctgacaacctcgaaataacctgaacgaggacgagggaccacggtacctatttattcgtgtacgacgaaggaggctaagtagtagggtaatacgttatttacgacttccccgacgactacgtacacgttacgtttagggttaccggtcgggggacccggtaccgtcggtccggtccttccgtcctcgaccgtcccgtacccgaccgaaccgggccctagtcccgtccttccccgtgccctaccctccaccgacgacgccgactccggg

SEQ ID NO: 358797 - DNA, 610 bp, Homo sapiens
  misc_feature: GZ8MTXP02GKY9I.9.34.D01.1.454.CMB.2.raw
  modified_base (257)..(257): a, c, t, g, unknown or other
  misc_feature (257)..(257): n is a, c, g, or t
  modified_base (346)..(346): a, c, t, g, unknown or other
  misc_feature (346)..(346): n is a, c, g, or t
  modified_base (384)..(384): a, c, t, g, unknown or other
  misc_feature (384)..(384): n is a, c, g, or t
  modified_base (432)..(432): a, c, t, g, unknown or other
  misc_feature (432)..(432): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgaccgcacgccgccctcagtgtcgtcggggccccagggcaggacggtcaccatctcgtagcacgtggaagtagctaccaanacgtcggggactaacggttatcgtatagtacacgtaggaacccaacaaccttccaaggaaccaccgacccctaaagtcactacatttancgaaacaacagtacgagccgtacctacggacggtcccngaccgtcttccgccgtacctaccgaaacgtcgtcgacacactccgacnccctacccgtcggcctaatccgacgcggtctaccgaaggctagagtactggagccgtagacgttaatcgtcgccgtagtctagtacgacggtagtacggtaaacctaaacggtactacgttacgtaaccggttacgtaaacggtacccggaacgtaaccgggtcctaccgttaccggg

SEQ ID NO: 358798 - DNA, 658 bp, Homo sapiens
  misc_feature: GZ8MTXP02GEAB9.9.34.D01.1.454.CMB.2.raw
  modified_base (343)..(343): a, c, t, g, unknown or other
  misc_feature (343)..(343): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgccgccctcagtcgtcgtcgggggccccagggcagagggtcaccgatctcgtgacacgtaggaagtgcctccaacgagtcggggctaacgttataggatcgtacaccgtaggtaacccaacaaccttccgaacgaacacgaccccaaagtcatcatttanacgacactatcgaacgtccgcctcgtacgggtccctgaccgtacttccgtaccggtcctaccgtaacgttccgtacgggacaacctacgtccaaccggtcccctcccgttcggaccctacgtacccgaacggtcgggtacctccggacgggtaccttagggaaggtagtacgggtaacgacgttacgtaaacgttactttacgcgtaccgtacgttacggtaataccgagtacggtacgtaaccgtaacgtacctaggttacttaaccggtacggtaacggtaccggtaaccgtacgtaaccgccgttacccggg

SEQ ID NO: 358799 - DNA, 666 bp, Homo sapiens
  misc_feature: GZ8MTXP02I3AN1.9.34.D01.1.454.CMB.2.raw
  modified_base (231)..(231): a, c, t, g, unknown or other
  misc_feature (231)..(231): n is a, c, g, or t
  modified_base (339)..(339): a, c, t, g, unknown or other
  misc_feature (339)..(339): n is a, c, g, or t
  modified_base (383)..(383): a, c, t, g, unknown or other
  misc_feature (383)..(383): n is a, c, g, or t
  modified_base (528)..(528): a, c, t, g, unknown or other
  misc_feature (528)..(528): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggaggactggagtgggtcgcaggcatcgctggtggcggtcatgacacattctacgcaaactccgtgagggccncttcatcatctccagagacaattcccagaacatactgtctctgctaactcaaactacctggacgaggcgaggacaccggcctaattttattctgttacggacgaaggnggactagtagtagggaacgtacgtattttcgactcccgtccgcncgtccgtactacgttttgaactttacgggcgggggtacccgggtaacccgttggtacccgcccgttcctcccgtcgacgtcccctaccgaccccgaacggcccctacgttccccggttccttcccccgtcggtaccccacccccncgtaccccgacgaccgtaccgtacccgtccggtacggggccgaccgaccggtccggtacccggtcggtaccggtcgtccgtacggtaccgtaacggtacgtaaccgttacgacgtacgtacgtccgtacgtacggcgg

SEQ ID NO: 358800 - DNA, 616 bp, Homo sapiens
  misc_feature: GZ8MTXP02IBKIY.9.34.D01.1.454.CMB.2.raw
  modified_base (235)..(235): a, c, t, g, unknown or other
  misc_feature (235)..(235): n is a, c, g, or t
  modified_base (276)..(276): a, c, t, g, unknown or other
  misc_feature (276)..(276): n is a, c, g, or t
  modified_base (334)..(334): a, c, t, g, unknown or other
  misc_feature (334)..(334): n is a, c, g, or t
  modified_base (376)..(376): a, c, t, g, unknown or other
  misc_feature (376)..(376): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctgggtggcggtcatgacacattctacgcaaactccgtggaggggccnttcatcatctcagagacaattcccaagaacatactgtctcngacaactcaataacctgagaggcgaggacacggcctattttattctgtgacgaaaggngctatagtagggaaacgtacgtattttcgacttccctccgcncgttcgaactctttagactttacggcggggaccccggggtaaaccctggtaccgtcccgttctccctcacgtccctaccaacccgaacgggcccaacgtcccggttccttcccccgtggcccctaccccttcccaccaagacgaccacccgtcggtacggggccaacgcggtccggcccgtgggctcggcctcggaccgaaaggcctaaccgttccgacgtaccgtactccacgtgacgg

SEQ ID NO: 358801 - DNA, 560 bp, Homo sapiens
  misc_feature: GZ8MTXP02IAGAX.9.34.D01.1.454.CMB.2.raw
  modified_base (232)..(232): a, c, t, g, unknown or other
  misc_feature (232)..(232): n is a, c, g, or t
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (320)..(320): a, c, t, g, unknown or other
  misc_feature (320)..(320): n is a, c, g, or t
  modified_base (373)..(373): a, c, t, g, unknown or other
  misc_feature (373)..(373): n is a, c, g, or t
  modified_base (404)..(404): a, c, t, g, unknown or other
  misc_feature (404)..(404): n is a, c, g, or t
  modified_base (443)..(443): a, c, t, g, unknown or other
  misc_feature (443)..(443): n is a, c, g, or t
  modified_base (466)..(466): a, c, t, g, unknown or other
  misc_feature (466)..(466): n is a, c, g, or t
tcagtgatacgtctcacgaccggtgctcgatttagatcgtctgtgttgggtttgggggaggcttggtccagcctgggggagtccctgcgactctcctgtgtggcctctggattcacctttgagacctatgccttgacctgggtccgccaggctccgaggggagggactgggagtgggtcgcaggcatcgctggtggcggtcatgacacattcacgcaaactcgtgagggccnttcatcatctcagagacaatcccagaacatactgctcnacaacacaatacngagngacgagcacgctatttnttcngtgagaaggagnagtagaggaatacgttatttcgacttcctcgctgtcactactttgatacgggngggacccgggaacccgtggccgccgtctccncacgcctccacgaacggcccacgtccgttccttccccgngtccctaccctccacgacgtacnccgaccgtcgtcggggcacgcggccgccgtgggctcgcgtacggtacgaacggtacctaaccgttacaacgtacgtactcgtacgtcggacggg

SEQ ID NO: 358802 - DNA, 698 bp, Homo sapiens
  misc_feature: GZ8MTXP02HMI5Y.9.34.D01.1.454.CMB.2.raw
  modified_base (219)..(219): a, c, t, g, unknown or other
  misc_feature (219)..(219): n is a, c, g, or t
  modified_base (247)..(247): a, c, t, g, unknown or other
  misc_feature (247)..(247): n is a, c, g, or t
  modified_base (272)..(272): a, c, t, g, unknown or other
  misc_feature (272)..(272): n is a, c, g, or t
  modified_base (444)..(444): a, c, t, g, unknown or other
  misc_feature (444)..(444): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacgagggtcctgggcccagtctgttctgacgcacgccgccctcagtgtcgtcggggccccagggcaggngggtacaccatctcgtgcatggaagtancctacaacgagcggggactacgttnagatcgtaactacgtacggtaaccaactaaccttaccgaacggaaaccaccgacccccaaagtcatactaatttacagaactaacataccggacgccggtaccctcggtacggggtcccctagacccgtacgttccgtacccggacctacgtaacgtcgtacggacctaacnccgtaccaccggtccccttcccggacggtcccaattccgaacgtccgggtctaccggagcgttacgggagtacgtagggcgtacgtacgttacgtaacgttacgtaccgggacctaaggttccgttaagacgggtaaaccgtacggggtaaacgtacccgttaaaacggtactaacggtttacccgttaacgggttaaccgggtaaaccggtacggggtaaaacccgtaaccggtttccggtaacccgttcggg

SEQ ID NO: 358803 - DNA, 734 bp, Homo sapiens
  misc_feature: GZ8MTXP02IEQBQ.9.34.D01.1.454.CMB.2.raw
  modified_base (229)..(229): a, c, t, g, unknown or other
  misc_feature (229)..(229): n is a, c, g, or t
  modified_base (238)..(238): a, c, t, g, unknown or other
  misc_feature (238)..(238): n is a, c, g, or t
  modified_base (253)..(253): a, c, t, g, unknown or other
  misc_feature (253)..(253): n is a, c, g, or t
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
tcagtgatacgtctcacgaccggtgctcgatttagatcgtctgtgttgggtttgggggaggcttggtccaggcctggggagtccctgcgactctcctgtgtggcctctggattcacctttgagacctatgccttgacctgggtccgccaggctccgaggggagggactgggagtggggtcgcaggcatcgctggtgggcggtcatgacacattctacgcaaactccggngaggggccnttcatcatctcaganacaacttcccaagaacatactgtctctgacaactcaataacctgagagcgaggacacggactatttattcngtgacgaaggngacagtagaggtaacgtacgttatttcgactcccgtcgacgtacgtcgacttactttagacgttacggtcggggacccgggaaccttgggacccgtccgtacctccgtacgaccgtaccccgtaccaacccggaaaccgggtccccctacggttcccgggttaccccttacccccgggttcggacccctacccccgtttaccgacccgaaaacggtccgcccgtaacccgtttccggggaaccggggccaaaccgtacccgggcccggggtcccctttacgggggaccctttccggggacccgtttacgggaaaacccggtaaacgggttaacccctaacccgttttaacccgaaacgggttaaccctaactttaccccggagtttaacgggacccggg

SEQ ID NO: 358804 - DNA, 777 bp, Homo sapiens
  misc_feature: GZ8MTXP02H4X88.9.34.D01.1.454.CMB.2.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgtctgacgcagcccgccctcagtgtcgtgggccccagggcagagggtccaccatctcgtgcacgtaggaagtacgcctaccgaaacacgtaccggggactacgttactgtatacgtaccaccgtacggtaacccctaaactaaccttaccgaacggaaacccaaccggaacccccctaaaagtacctaaactttaccgttaatttaaacgtacgaaacctaaaacgtacgtaaccgggaaaaccgggtcccccggtacccccgtaaccggggtacccgggggttaccccccgttaccgggtacccggttaaacccgttttcccgggtaccccccggggttacccttaacccgaaaccggttccgttaccgggaacccttaaaccgacttacccgtaacccgtcccccgttaccccgttaccggacccctaacgtcccgtaaccgttcggggacctacccggacggtccggttaggaacggtagtacgggtaaggtcctaagtaacttagtacgttacgaccgtagtacgtagtacgtaacgtacgtacgtaacgtaacgtactacgttcgtaacgtacgacgtacggtaacacggtccgtacgtcg

SEQ ID NO: 358805 - DNA, 729 bp, Homo sapiens
  misc_feature: GZ8MTXP02JENF9.9.34.D01.1.454.CMB.2.raw
  modified_base (205)..(205): a, c, t, g, unknown or other
  misc_feature (205)..(205): n is a, c, g, or t
  modified_base (232)..(232): a, c, t, g, unknown or other
  misc_feature (232)..(232): n is a, c, g, or t
  modified_base (332)..(332): a, c, t, g, unknown or other
  misc_feature (332)..(332): n is a, c, g, or t
  modified_base (358)..(358): a, c, t, g, unknown or other
  misc_feature (358)..(358): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcgtcatgacanattcacgcaaactccgtggaggggccncttcatcatctccagagactaattcccaagaaacatactgtctctgacaactcaaatacctgagaggcgagacacggctatttattctgtgacggaaggngactaagtagtagggaaacgtacgtnttttacgacttccccgcggtacaggtccgacttacgttttagacgtttacggtcggggggacccggtaacccgttgggtaccctcccggtcttcccgtccgacgtccccctaacgaaccccggtaacgggtcccctaagtttccccggtccccctttcccccgggtacggccccctaacccccttcccgtaacccgaaacggtccggtacccctaacccggttcggggtaccgggggaccaacggtacccgggtcccggggtccccgtgggggtaaccgtccggtcccgttacggggaaaccctaacggggtacccttaaccggttacccgaacgggtaccttacgtacccgtaacggtcggggaaccggg

SEQ ID NO: 358806 - DNA, 837 bp, Homo sapiens
  misc_feature: GZ8MTXP02H98HK.9.34.D01.1.454.CMB.2.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgcccgccctcagtcgtccgtcgggggcccccagggccaggacgggtcaccatctcgtgccacgtaggaagtacgcctaccaacgacgtccggggtactaacggtttatggaattacgtaacctacgtacggtaaacccaaactaaccttaccgaacggaaaccaacccgaaccccctaaaagttccaaacttacttaatttaagacgtaaacaacgtacgttaccggaaaccggtccggtacccccgttacgggtaccggggttacccccgttaacgggtacccggttaacctttccccggtaccccggggtacccttacccgtaaaggttcccgtacggaccctaacgaccttaccggaacccgttcccccgtaccccgttacgggacccctaagttccccgtaaccggttccgggacccttaccgggaaccgtccggtagggaggtacgttacgggaacggttctaacggttaaccttacgtttaccgcggtaaaccctagggtttacgttaacgtacggtaaccgtacggggttaccgtaaaacccgttacgttaaaacccgttgtttaccccggttaacggtttaaccgggaaacggttacccggggaaaaccgtaacccgggtttaccggtaccccgggtttaaccggg

SEQ ID NO: 358807 - DNA, 638 bp, Homo sapiens
  misc_feature: GZ8MTXP02GHWUS.9.34.D01.1.454.CMB.2.raw
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
  modified_base (316)..(316): a, c, t, g, unknown or other
  misc_feature (316)..(316): n is a, c, g, or t
  modified_base (336)..(336): a, c, t, g, unknown or other
  misc_feature (336)..(336): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgcaggctccgaggggaggactggagtgggtcgcaggcatcgctggtggcggtcatgacacattcacgacaaacgtccgtgaggggccnttnatcatctcaganacatccagaacatactgtcntgcaactcaaatactgagaggcagggacacggtacctattttactctgtagacgaaggaggacaagtagaggggaaattacgttagttttcgacttcccgccgagtacgtaccggactttcgtttagacggtttaccgcggggggacccgggtaacccttcgggccgtcccgtaccttccgcgtaccgcccgttacccgaaccgaaccggggtaccctacggtttccccggtttccccctttacccccgcggtacccctaacccccgtttccgaacccgaaacggccgtaccctaacccggg

SEQ ID NO: 358808 - DNA, 591 bp, Homo sapiens
  misc_feature: GZ8MTXP02FRM7C.9.34.D01.1.454.CMB.2.raw
  modified_base (233)..(233): a, c, t, g, unknown or other
  misc_feature (233)..(233): n is a, c, g, or t
  modified_base (390)..(390): a, c, t, g, unknown or other
  misc_feature (390)..(390): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggcctatttatttctgtgcgaaggagcatatggggaactacgtattttcgacttccctccgcagtcgactactttgactttacgngggggcccgggaaccctggtccgccgtctccctcacgccctccacccgaagggcccagtccggtcccttacccccgtcggccacccctcctacccaacgacgccaccgtcgtggggccacgacgccggcccgtgggccttcgggcctacgggtaccaagggtaacctaaccgttccgacgtacgtactcgacctgaacggg

SEQ ID NO: 358809 - DNA, 589 bp, Homo sapiens
  misc_feature: GZ8MTXP02HH1KJ.9.34.D01.1.454.CMB.2.raw
  modified_base (247)..(247): a, c, t, g, unknown or other
  misc_feature (247)..(247): n is a, c, g, or t
  modified_base (303)..(303): a, c, t, g, unknown or other
  misc_feature (303)..(303): n is a, c, g, or t
  modified_base (320)..(320): a, c, t, g, unknown or other
  misc_feature (320)..(320): n is a, c, g, or t
  modified_base (344)..(344): a, c, t, g, unknown or other
  misc_feature (344)..(344): n is a, c, g, or t
  modified_base (367)..(367): a, c, t, g, unknown or other
  misc_feature (367)..(367): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctggggggaggcttggtccagcctggggatccctgcgactctcctgtgtggcctctggattcacctttgagacctatgccttgacctgggtccgcaggctccgaggggagggactgggagtgggtcncaggcatcgctgggtggcggtcatgacacattctacgcaaactccgtgaggggccncttcatcatctccaganacaattcccaagaacatactgtcnctgcaaaccctcaaagttaaccngaagaggcgaggaccacggcctatttattcngtgcgaaaggnggacatagtgggaagttacgtatttcgaactccctacgcaagtcgacttacgtttagacgttacggtacgggggccgggtaaccgtcggtccgtccggtctaccgtcaccgccctaccgaccgtacggcctacgtcccgtccttcccgtaacgcctcccctcctaccacgacgactccgg

SEQ ID NO: 358810 - DNA, 665 bp, Homo sapiens
  misc_feature: GZ8MTXP02GKO10.9.34.D01.1.454.CMB.2.raw
  modified_base (234)..(234): a, c, t, g, unknown or other
  misc_feature (234)..(234): n is a, c, g, or t
  modified_base (251)..(251): a, c, t, g, unknown or other
  misc_feature (251)..(251): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtggaggggccncttcatcatctccaganacaacttcccaagaacatactgtctctgacaaactcaaataacctgaaggacggacgaaggaccacggtacctaattttatttcgtggtagacggaaaggagacaagtagtaggggaaacgttacgtattttcgacttccccgtccgacagtccgaactacgtttagaactttacgggcggggggtaccccggggtaacccgtcgggtacccgtcccgtcctccctcacgccctaccaaccgaacgggccccacgtcccggttccccttcccccgtcggcccacccctccctaccgaacgacgccaccgtcggtcggggacacgacggccggacccgtgggaccgtcgtccgtacggtaccgaacggtaccttaaccgtaccgaacgtaccgtaactcgaaccgtacggacggg

SEQ ID NO: 358811 - DNA, 700 bp, Homo sapiens
  misc_feature: GZ8MTXP02GNWEH.9.34.D01.1.454.CMB.2.raw
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagcccgccctcgagtgtccgtcggggccccagggcaggagggtcaccactctcgtagcacgtggaagtgctaccaacgagtcggggctacgttatgatacgtaccactacggtaaccaacaacttccgaagaacaccgaccccaaagtcaactctatttaatcgaacaactagtacgaacgtcccggacccccgttacggaaccgggggttcccctaacggtaccccggtaacgtttcccgtacccccgggggaccttaaccccggtaaacgtttcccgtacgggacccaacgtacctaccgaaccgtccccgttccccgtcggaccctacttaccggacccgtacggggccccttaccggaacggtccgtagggaaccggtaagttggggaaacgtccgtaggttaacttacgttaccgtgtaccgtaacggtacttacgtacgaccgtagtacggacttaaacgactagtacgttccgtacggaacgtacggtaccgtaaacggtccgaccggttccg

SEQ ID NO: 358812 - DNA, 681 bp, Homo sapiens
  misc_feature: GZ8MTXP02FLVGP.9.34.D01.1.454.CMB.2.raw
  modified_base (191)..(191): a, c, t, g, unknown or other
  misc_feature (191)..(191): n is a, c, g, or t
  modified_base (251)..(251): a, c, t, g, unknown or other
  misc_feature (251)..(251): n is a, c, g, or t
  modified_base (325)..(325): a, c, t, g, unknown or other
  misc_feature (325)..(325): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctnagtgtctggggccccagggcaggagggtcaccatctcgtgcacgtggaagtagctccaanatcggggcacgttatgatgtacactggtaaccaaacaacttccaaggaacacgacccccaaagtcatcatttangacaacatacgaacgccggaccctcgaacggggtccctgacccgacttccgtcccggacctaccctaaggtccgtcgggaccactaactccgaacgtccccttccccgtcggacccctaagtccgaaccgttcggggcccttacccgacggggtcctagggaagggacgttacgggacggtaccctagggaacctttaaaacgttccgtacggacccgtaacgttccggttaaaagttcgggaacctaaagggtcgggtaaacccttaaaacgtaaaccgacgtttaccggtaaccgtttaacgggaaaaccggtcgggggtaaaaccctaaagggtcccgtaacccggttcccgg

SEQ ID NO: 358813 - DNA, 682 bp, Homo sapiens
  misc_feature: GZ8MTXP02HJPEY.9.34.D01.1.454.CMB.2.raw
  modified_base (235)..(235): a, c, t, g, unknown or other
  misc_feature (235)..(235): n is a, c, g, or t
  modified_base (253)..(253): a, c, t, g, unknown or other
  misc_feature (253)..(253): n is a, c, g, or t
  modified_base (280)..(280): a, c, t, g, unknown or other
  misc_feature (280)..(280): n is a, c, g, or t
  modified_base (296)..(296): a, c, t, g, unknown or other
  misc_feature (296)..(296): n is a, c, g, or t
tcagtgatacgtctcacgaccggtgctcgatttagatcgtctgtgttggggtttgggggaggcttggtccagcctggggagtccctgcgactctcctgtgtggcctctggattcacctttgagacctatgccttgacctaggtccgccaggctccgaggggagggactggagtgggtcgcaggcatcgctgggtggcggtcatgacacattcacgcaaactccgtggaggggccncttcatcatctccaaganacaacttcccaagaacatactgctacnacaactacaataaccngagagacgaggacacggctatttcttcgtagtcgacggaaggagacagtagtaggaacgtacgtatttcgactcctacgactacgtaccgtacttacgttagtacgttacgggacgggggtacccggggaaccgtcggtcccgtccgtcctccgtcacgtcccaccgaccgacgggccctacgttcccggtcccttaccccgcggtaccctaccccgtaccgtacccaaacgccgtacccgtccgtaccgggtacgggggaccaaccgggtacccggtacccggtcccggtggggtaccctcgggtcccgttacgggtaccgtaaacgggtaccttaacccgttacgaaacggttccgtaacgtaccggtacgttacgggaccggg

SEQ ID NO: 358814 - DNA, 679 bp, Homo sapiens
  misc_feature: GZ8MTXP02IMFOY.9.34.D01.1.454.CMB.2.raw
  modified_base (145)..(145): a, c, t, g, unknown or other
  misc_feature (145)..(145): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccnccaggctccgaggggagggactggagtgggtcgcaggcatcgctggtggcggtcatgacacattctacgcaaactccgtgaggggccgcttcatcatctccagagacaacttcccaagaacatactgtctctgacaactacaaataacctgaggaggcgaggacacggacctatttattctgtagacgaaggagcagtagtaggggtaactacgtattttaccgacttccccgtcccgcacggttccgaacctaacgttttgaacgtttacggtcggggggaccccgggtaacccgtcggtcccggtcccgtccttcgtcccgacgcccctaccgacccgaaccggggtcccctacgttcccggttccccttcccccgtccgggtaccctacccccgtccctaccccgaaacggaccgcccgtaacccgtcggtccgggggctaacgcggtcccggcccgtcgggccgtacgccgtacggtacgtaacggtactaaccgttcccgacgtacgtacacgtacgtcggtaccgggg

SEQ ID NO: 358815 - DNA, 739 bp, Homo sapiens
  misc_feature: GZ8MTXP02JZ7DX.9.34.D01.1.454.CMB.2.raw
  modified_base (394)..(394): a, c, t, g, unknown or other
  misc_feature (394)..(394): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacgagggtccctgggcccagtctgttcctgacgcacgcccgccctcaggtcgtccgtcggggccccaggggccaggacgggtcaccgtatcgtcgtgcacgttggaagtacgcctacccaacgtacggtccggggactacggttatgagttacgtacctaacgttacggtaaaccaaacctaaaccttaccgaaacggaaccctaaccggacccccctaaaaggtccaacttactaagttttanacgtaacaaactagtaccgaacggtccgccccgttacgaaccggggttccctacgggaccgtacgttccgtacccggtcttaccgaacgtcgtacggacaacgtactccgacgtcccttccgcgaccctacggtccgtaccggtcggtccgttaccgacggtcgttaggggacgtacgtcgggacggtaccttacgttaacgtacgttacgtccgaccgtaggtacgttacgacggtacgaacggttacggtaaaccttaaacggttaaccctaaggttcccgtaacggtttaccggaaaaccgacggggtaacccgttacggtaccccgttacgggttacccgg

SEQ ID NO: 358816 - DNA, 735 bp, Homo sapiens
  misc_feature: GZ8MTXP02FPVXR.9.34.D01.1.454.CMB.2.raw
  modified_base (216)..(216): a, c, t, g, unknown or other
  misc_feature (216)..(216): n is a, c, g, or t
  modified_base (266)..(266): a, c, t, g, unknown or other
  misc_feature (266)..(266): n is a, c, g, or t
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
  modified_base (352)..(352): a, c, t, g, unknown or other
  misc_feature (352)..(352): n is a, c, g, or t
tcagtgatacgtctcacgaccggtgctcgatttagatcgtctgtgttgggtttgggctgacctggctttttctcgtggctgttttaaaaaggtgtccagtgtgaggttcaactgttggagtctgggggaggcttggtccagcctggggagtccctgcgactctcctgtgtggcctctggattcacctttgagacctatgccttgacctggggtccnccaggctccgagggggagggactgggagtgggtcgcaggcatcgctgggnggcggtcatgacacattctacgcaaactccggtggacggggccncttcatcatcnccagagacaattccccaagaacatactgtcnctgcaactcaaataactgagaggcgaggaccacggtctattttattcgtgtgacgaaaggaggactaagtagtaggggtaaacgtacgttatttttaccgacttcccccgttaccgacgtaacggttaccgaacttacgtttacgtaaacgttttaccggggacccggggggtaaccccgggggtaacccgttcgggggttccccggtccccggttcccttcccgtacccgaaccggtcccccttacccgtaaaccccggaaaaccgggggtccccctaacggtttcccccggggttccccctttacccccccggcgggtacccccttaacccccgttacccccgttacccgaaaaacggtcccggacccctttaaccccggg

SEQ ID NO: 358817 - DNA, 487 bp, Homo sapiens
  misc_feature: GZ8MTXP02GBAEE.9.34.D01.1.454.CMB.2.raw
  modified_base (309)..(309): a, c, t, g, unknown or other
  misc_feature (309)..(309): n is a, c, g, or t
  modified_base (319)..(319): a, c, t, g, unknown or other
  misc_feature (319)..(319): n is a, c, g, or t
  modified_base (406)..(406): a, c, t, g, unknown or other
  misc_feature (406)..(406): n is a, c, g, or t
  modified_base (477)..(487): a, c, t, g, unknown or other
  misc_feature (477)..(487): n is a, c, g, or t
tcagtgatacgtctcacgaccggtgctcgatttagatcgtctgtgttgggtttgggggctgttcctggaagttgttggtaccagtgtcaccatctcgtgcactggaagtagctccaacatcggggcacgttatgatgtacactggtaccaacaacttccaggaacagcccccaaagtcatcatttatgacaacatgaagccggccctcgacggggtcccctgaccgattcctccggctccaagtctggcacatcagcctcctggccatcactggctccagctgagatgaggctgtattatactcgaccnctccatgacngcagctgagagtgtggtagtcggcggaggaccaagcgtcgaccgtcgtacggacaccgccgaacggcctcccgtccccctcggtacnccttcttccgtcccccaccctctacacgtacgtactccagtcggcgtcgggcgtcgaccgaaggcctagannnnnnnnnnn

SEQ ID NO: 358818 - DNA, 584 bp, Homo sapiens
  misc_feature: GZ8MTXP02G7WO1.9.34.D01.1.454.CMB.2.raw
  modified_base (333)..(333): a, c, t, g, unknown or other
  misc_feature (333)..(333): n is a, c, g, or t
  modified_base (376)..(376): a, c, t, g, unknown or other
  misc_feature (376)..(376): n is a, c, g, or t
  modified_base (534)..(534): a, c, t, g, unknown or other
  misc_feature (534)..(534): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctggcccagtctgttctgacgcagccgcctcagtcgtcgtggggccccagggcagacgggtcacctatctcgtgcacgtggaataggcctccaacatcggggacacgtatcgatgtacactcggtaccaacaactccaagaacacgaccccaaagtcatcgatttacagacaaacnctagaacgtccgccctacgacggggtcccagacccgtattccnccgacgttacccaaagtcctacggacacactcaacgcctcccgtgccctagtcctaacgtcggacttaccgaggtacctagaacgattaggacggcttaggaccttattacgtcggacctagtaccttagacgaaacgtgtacgtacctaacgtaacncttacggtcttacggaacttacggggaacctacgttaccgacgttcccgg

SEQ ID NO: 358819 - DNA, 663 bp, Homo sapiens
  misc_feature: GZ8MTXP02FNT4K.9.34.D01.1.454.CMB.2.raw
  modified_base (587)..(587): a, c, t, g, unknown or other
  misc_feature (587)..(587): n is a, c, g, or t
  modified_base (651)..(651): a, c, t, g, unknown or other
  misc_feature (651)..(651): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggagggactgggagtgggtcgcgaggcatcgcgtgggtggcggtcatgacacattctacgacaaactccggtggacggggccgtcttcatcatctccagagacaactccaagaacatactgtctctgcaactacaaataacgtgagaggcgtaggaccgacggtacctaattttacttctggtacgacggaaagggcggtacaagtaacggtagggaacgtaccgtttatttaccgaactccccgtccgacgtcgtaccaacttactttagaacgtttacggggcgggggacccgggtacccgtgggtcccgtcccgtctcgtcccgacgtccctaaccgaaccggaaaccgggccctacggttccggttcccccttcccccgtacggccccaccccttacccgacgaacgacgtcccacgttcgggnggaccgacgacgcccggtacggtcggccgtacgctacgggacaacgtctaacgtcgaagtactnacctagcggagg

SEQ ID NO: 358820 - DNA, 785 bp, Homo sapiens
  misc_feature: GZ8MTXP02G8B16.9.34.D01.1.454.CMB.2.raw
  modified_base (215)..(215): a, c, t, g, unknown or other
  misc_feature (215)..(215): n is a, c, g, or t
  modified_base (311)..(311): a, c, t, g, unknown or other
  misc_feature (311)..(311): n is a, c, g, or t
  modified_base (382)..(382): a, c, t, g, unknown or other
  misc_feature (382)..(382): n is a, c, g, or t
tcagtgatacgtctcacgaccggtgctcgatttagatcgtctgtgttgggtttgggctgacctggctttttctcgtggctgttttaaaaggtgtccagtgtgaggttcaactgttggagtctggggggaggcttggtccagcctggggagtccctgcgactctcctgtgtggcctctggattcacctttgagacctatgccttgacctgggtccnccaggctccgagggggagggactgggagtgggtcgcaggcatcgctgggtggcggtcatgacacattcaacgcaaacgtccggtaggacggggccncttcatcaatctccaggacaactaacttccccaagaacctatactgtacctctgacaactcaaattaccgngagaggcgagggtaccaacggtcctaagtttttacttcgtggtacgacgaaagggacgataagttaggtaggggtaaagtaaccgttagtttttaccggaacctttccccgtacccggacgtaacgttaccgtaaaccgtttacgttttacggtaacggtttacccgggtacgggggggttaacccccgggggtaaaccccgttcgggggtaccccggttacccccgtttccgttcccccgtacccgtacccggttaccccccgttaccccgaaaacccccggtaaccggggtaaccccctaaccggttcccccgggtttccccctttacccccccgtccgggaccccctaaccccccttccgttaaacccaaacggtacccgaacccgtttaacccccgggg

SEQ ID NO: 358821 - DNA, 700 bp, Homo sapiens
  misc_feature: GZ8MTXP02IUZ3H.9.34.D01.1.454.CMB.2.raw
  modified_base (191)..(191): a, c, t, g, unknown or other
  misc_feature (191)..(191): n is a, c, g, or t
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (332)..(332): a, c, t, g, unknown or other
  misc_feature (332)..(332): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctnagtgtcgtcgggccccagggcaggacggtcaccatctcgtgcagtggaatagcctacaacngtcgggactacgttangtatgacacgtacggtacaacacttacaggaaccacgacccctaaagcctatactatttacganacaactacgtacgaacgccgtaccctacggacgggtccctacgaccgttacttcccgtacccggccttaccgtaacggtcgtacggactacgactccgaccgtcccgttaccgtacgcctacttaccggtaacggttcgggacccttaccgggaaacgggttaccggtagggtaacgggtaccgtaggggaacccggtacgttaccgggtaaacttttacgtaaaccggttcggtaacccgttagttacccggttaagttaccggtaaacgggtacgtaccgggttaaacccttaaaggtacctacggttacgttaaccgtaacggtaaccgtacggggaacctacgggttaccctaccggttaccgg

SEQ ID NO: 358822 - DNA, 694 bp, Homo sapiens
  misc_feature: GZ8MTXP02JBV6S.9.34.D01.1.454.CMB.2.raw
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacgagggtcctgggcccagtctgttctgacgcacgccgcctcagtcgtcgtcgggccccagggcagacggtcaccatctcgtgctacgtaggatacgctaccaatagtcgggactacgttagcgtagtcgtactacgtacggtaaccaacctaaacgtccgaaacggtaaccaccgaccccctaaagtcattactatttacacgaacaactagtacgaacgcccgtaccctacggacgggttaccccagtacccgtacgttcccgtccggtacctaccgtaacggttccgacgggaacctaactaccgttcccgacgggtccccctttacccgcgaaccctacgttaccccgagtaccgggtaccttccgggaaaggtccggttaaggaccgtaggtagggaacggttctacggtaaactttccgttacgacggtacctaggtacgtttaagcggaaccttagggtaaccttaaaccgtaaacgttacgtcgtaacgtttcggtacggaaacgtcgggaaacttacccggcgtacccggttccgg

SEQ ID NO: 358823 - DNA, 581 bp, Homo sapiens
  misc_feature: GZ8MTXP02FIDEH.9.34.D01.1.454.CMB.2.raw
  modified_base (235)..(235): a, c, t, g, unknown or other
  misc_feature (235)..(235): n is a, c, g, or t
  modified_base (321)..(321): a, c, t, g, unknown or other
  misc_feature (321)..(321): n is a, c, g, or t
  modified_base (327)..(327): a, c, t, g, unknown or other
  misc_feature (327)..(327): n is a, c, g, or t
  modified_base (335)..(335): a, c, t, g, unknown or other
  misc_feature (335)..(335): n is a, c, g, or t
  modified_base (367)..(367): a, c, t, g, unknown or other
  misc_feature (367)..(367): n is a, c, g, or t
  modified_base (502)..(502): a, c, t, g, unknown or other
  misc_feature (502)..(502): n is a, c, g, or t
  modified_base (523)..(523): a, c, t, g, unknown or other
  misc_feature (523)..(523): n is a, c, g, or t
  modified_base (529)..(529): a, c, t, g, unknown or other
  misc_feature (529)..(529): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgacaaactccgtggaggggccncttcatcatctcagagacaacttcccagaacatactgtctctgcaactacaataacctgagaggcgaggacacggctatttatttntcccgngcgaaggngcatagtaggtaatacgtatttcgacttcccncgctgtaccgaactactttgattcggtacgggggacccggggtaacccgttggccgtcccgtcctccctcacgccctcccaccgaacgcccgctccgtcccttccccgcgccacccctccaccacgacgctaccncggcgggcacgacgccgccgnggtccncgtccgcgtacgaacgtactaacgtactacggtactagtacacgtagacggg

SEQ ID NO: 358824 - DNA, 630 bp, Homo sapiens
  misc_feature: GZ8MTXP02JBF98.9.34.D01.1.454.CMB.2.raw
  modified_base (214)..(214): a, c, t, g, unknown or other
  misc_feature (214)..(214): n is a, c, g, or t
  modified_base (248)..(248): a, c, t, g, unknown or other
  misc_feature (248)..(248): n is a, c, g, or t
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
tcagtgatacgtctcacgaccggtgctcgatttagatcgtctgtgttgggtttgggctgacctggcttttttctcgtggctgttttaaaaggtgtccagtgtgaggttcaactgttggagtctgggggaggcttggtccagcctggggatccctgcgactctcctgtgtggcctctggattcacctttgagacctatgccttgacctgggtccnccaggctccgagggggaggactgggagtgggtcncaggcatcgctggtggcggtcatgacacattctacgcaaactccgtgacggggccnttcatcatctcagacgacaattccaagaacatactgtctcngacaactcaatacctgagacggacgaggacacggctatttattctgtcgacgaaggagcagtagagggtaagtacgtacgttttcgactacccgtcgacagtaccgacttacgtttcggtacggtcgggggacccgggtaaccgtcggtccggtcccgtccgttacctcgacggtcccctaccgaaccgtaaacccggggcccctaacgtcccggttaccccttcccccgttcggaacccctacccctaccgtacccgaacggacctacccgcccgttaccgggg

SEQ ID NO: 358825 - DNA, 685 bp, Homo sapiens
  misc_feature: GZ8MTXP02GOY99.9.34.D01.1.454.CMB.2.raw
  modified_base (191)..(191): a, c, t, g, unknown or other
  misc_feature (191)..(191): n is a, c, g, or t
  modified_base (266)..(266): a, c, t, g, unknown or other
  misc_feature (266)..(266): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacgagggtcctgggcccagtctgttctgacgcagccgccctnagtgtctcggggcccaggcagaggtcaccatctcgtgcacgtggaagtacgctccaatagtcggggcacggttangactgtacacgtacggtaccaaactaaacgttcccgaaggtaaaccacggaaccccccctaaaggttacctaactaccgtaatttttacgacgtaacaaacctagtacgaaacgccggtaccctacggacggggtcccttagacccggtcttccgtacccgggtcttaccgaaaggtcctacgggacacgtactaccgacgtcccctcccgtacggacccctagtccgaacgttcgggccttaccggaaacggtaccgtcgtagggaccgttggacgggtaccttacggtactacgtttaacgacgtacgtacggttaccgtacgttagaacccttaggtaccgtaaacgtaaacgtaacaccgtttaccgtaacgttacggaaacgttaccggggaccaacggttcaaccggtttccg

SEQ ID NO: 358826 - DNA, 738 bp, Homo sapiens
  misc_feature: GZ8MTXP02GMLFD.9.34.D01.1.454.CMB.2.raw
  modified_base (269)..(269): a, c, t, g, unknown or other
  misc_feature (269)..(269): n is a, c, g, or t
  modified_base (278)..(278): a, c, t, g, unknown or other
  misc_feature (278)..(278): n is a, c, g, or t
tcagtgatacgtctcacgaccggtgctcgatttagatcgtctgtgttgggtttgggggaggcttggtccagcctgggggagtccctgcgactctcctgtgtggcctctggattcacctttgagacctatgccttgacctgggtccgccaggctccgaggggagggactggagtgggtcgcgaggcatcgcgtgggtggcggtcatgacacattctacgcaaactccggtggagggccgcttcatcatctcagagacacttccaagaacntactgtctntcgacaactacaaataaccgtgaagaggacgaggtaccacggtccttaattttatttcgtggtacggaacggaagggcggactaagttaggtacgggtaaacgttaccgttaaactttttcgaaccgttccccgtaccgtcgtaccgttcgtaaccttacgtttagtaacggttacgggtccggggggtacccgtaacccgttgggtaccccgtcggttacctccgttaccgaccgtcccgtacccgaaccggaccgggtaccctacgttcccggtttcccccttacccggtccggtacccctaccccgtaccctacccgaaacggccgtccgaaccggttccgggacggggccaaaccggccggtcccggtaccggttggcccgtacgtccggttacgaaccgtacggttaactaacccgttacccgtaagtacgtacctacgaacgttaccggggcgg

SEQ ID NO: 358827 - DNA, 657 bp, Homo sapiens
  misc_feature: GZ8MTXP01EA3I8.17.33.C11.1.454.CMB.2.raw
  modified_base (186)..(186): a, c, t, g, unknown or other
  misc_feature (186)..(186): n is a, c, g, or t
  modified_base (285)..(285): a, c, t, g, unknown or other
  misc_feature (285)..(285): n is a, c, g, or t
  modified_base (305)..(305): a, c, t, g, unknown or other
  misc_feature (305)..(305): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctnacgctgacctgcaccttctctggcttctcactcagaacgagtaggaagtgggagtgggctggatccgcagccccaggaagcctggagtggcttgcgctntattagtggatgagagtacncactacacgtccgtctctagaagaacacgtctaccaccactaccgaaccgaacgaacctaaccctaacccgaaacaaaccgtagggtacgttacctaacaatacgaacctaagtacgtacggtacctaggtacgaaccacacgacctaactaattaactttacgtcgttacgtacgtacgttacgttacggttacgggttacggggttacggtttaacgtttacgttacccgtttacgtttacgttacgttacggtaacgggtacggacgggtacgttacgtcggtccgttaccgttccgttccgtccgaccgtaaccgtacccgaccgaccggtaacccgttaaccgtccg

SEQ ID NO: 358828 - DNA, 517 bp, Homo sapiens
  misc_feature: GZ8MTXP01AD557.17.33.C11.1.454.CMB.2.raw
  modified_base (356)..(356): a, c, t, g, unknown or other
  misc_feature (356)..(356): n is a, c, g, or t
  modified_base (375)..(375): a, c, t, g, unknown or other
  misc_feature (375)..(375): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
tcagcgtagactagcacgaccggtgctcgatttagagtgagctcgttgggtttgggactcctgtgcccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatacggcacgccccaggaagcctggagtggcttgcgctcatttatgggatgagagtaagcactacagtccgtctctgaagaacaggctcaccatcaccaaggaacacctccanaaaccaggtcgtccttaanatcacaatatacgacgtgtgacacacacacatatactntcgcnctctagtggtggtagttagttacgtctcttacgtacgtcgtcggcgacggtacgttcgtcgtcgccgttcttccgcncgccnccaccgacgccgcgtcg

SEQ ID NO: 358829 - DNA, 530 bp, Homo sapiens
  misc_feature: GZ8MTXP01DNX08.17.33.C11.1.454.CMB.2.raw
  modified_base (269)..(269): a, c, t, g, unknown or other
  misc_feature (269)..(269): n is a, c, g, or t
  modified_base (508)..(508): a, c, t, g, unknown or other
  misc_feature (508)..(508): n is a, c, g, or t
  modified_base (520)..(520): a, c, t, g, unknown or other
  misc_feature (520)..(520): n is a, c, g, or t
tcagcgtagactagcacgaccggtgctcgatttagagtgagctcgttgggtttggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccnggacaagcacccaggcactcatttatagtacaaacaacaaacactcctggacccctgcccgattctcagcctccccctccttgggggcaaagctcgccctgacactgtctggtgtgcagcctgaggacgaggctgactattactgcctactctactttggggtggttgcttgtgctagttcggcggagggaccaagctggaaccgtcttaagtcagcccaaggccttcgcccctggtcnctctcgttcccncccttcctcc

SEQ ID NO: 358830 - DNA, 527 bp, Homo sapiens
  misc_feature: GZ8MTXP01CA8I0.17.33.C11.1.454.CMB.2.raw
  modified_base (378)..(378): a, c, t, g, unknown or other
  misc_feature (378)..(378): n is a, c, g, or t
  modified_base (423)..(423): a, c, t, g, unknown or other
  misc_feature (423)..(423): n is a, c, g, or t
tcagcgtagactagcacgaccggtgctcgatttagagtgagctcgttgggtttggggactcctgtgccccaccatggacacactttgctccacgctcctcgctgctgaccatcccttcatgggtcttgtcccagatcaccttgaaggagtctggtcctacgctggtgaaacccacaccagacccctcacgctgacctgcaccttctctggcttctcactcagaacgagtggaatgggagtgggctggatccgtcagcccccaggaaaggccctggagtggcttgcgctcatttagtggatgagagtagcacgtacagtccgtctctgaagacagctccacatcaccagaacacctcacaaaccagtgtccttacaatnaccaatatggaccctgtggacacagccacatatactgtcacgctntatggttcgggattattagtccctatttgactctggggcccagggacttcgtcggtcaccgttcttaccgcagcctcctaccgacgggtcccttaagttcccgg

SEQ ID NO: 358831 - DNA, 547 bp, Homo sapiens
  misc_feature: GZ8MTXP01DXFRC.17.33.C11.1.454.CMB.2.raw
  modified_base (327)..(327): a, c, t, g, unknown or other
  misc_feature (327)..(327): n is a, c, g, or t
  modified_base (387)..(387): a, c, t, g, unknown or other
  misc_feature (387)..(387): n is a, c, g, or t
  modified_base (415)..(415): a, c, t, g, unknown or other
  misc_feature (415)..(415): n is a, c, g, or t
  modified_base (455)..(455): a, c, t, g, unknown or other
  misc_feature (455)..(455): n is a, c, g, or t
  modified_base (513)..(513): a, c, t, g, unknown or other
  misc_feature (513)..(513): n is a, c, g, or t
tcagcgtagactagcacgaccggtgctcgatttagagtgagctcgttgggtttgggggtacgtcctgtgccccacccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatcccgtcagcccccaggaaaggccctggagtggcttgcgctcatttattgggatgagagtaagcactacagtcccgtntctagaagaacaggctccaccatcaccaagaaccacctcacaaaccaggtcgtaccttanaatgaccaatatggaccctgtgaacacngccacatagttactgttcactcttctagtgggttcggggnttattacgtccctactttgctacgtggggcaggggaacttgtgggtcaccgttcttcncagccctccaccgaagggtccccaattccccggg

SEQ ID NO: 358832 - DNA, 541 bp, Homo sapiens
  misc_feature: GZ8MTXP01DNJGP.17.33.C11.1.454.CMB.2.raw
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
  modified_base (417)..(417): a, c, t, g, unknown or other
  misc_feature (417)..(417): n is a, c, g, or t
  modified_base (477)..(477): a, c, t, g, unknown or other
  misc_feature (477)..(477): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccnggacaagcaccaggcactcatttanagtaacaaacaacaaacactcctcggacccctgcccgattctcaggctccccctccgttggggcaaagctcgccctgacactgtctggtgtgcagcctggaggacgaggctagactattacngcctactcttactttggggtgtgtctgtgctagttcggcgggaggacaagctgaaccgtnttaagtcacgacccaaggccttcgcccctcggtcaactccgtcttcccctaacccttccgtccc

SEQ ID NO: 358833 - DNA, 518 bp, Homo sapiens
  misc_feature: GZ8MTXP01DICLQ.17.33.C11.1.454.CMB.2.raw
  modified_base (219)..(219): a, c, t, g, unknown or other
  misc_feature (219)..(219): n is a, c, g, or t
  modified_base (267)..(267): a, c, t, g, unknown or other
  misc_feature (267)..(267): n is a, c, g, or t
  modified_base (405)..(405): a, c, t, g, unknown or other
  misc_feature (405)..(405): n is a, c, g, or t
  modified_base (426)..(426): a, c, t, g, unknown or other
  misc_feature (426)..(426): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaanactggagcagtcaccagtgcttacatccaaatggtccagcagaaaccnggacaagcaccagggcactcatttatagtacaaacaacaaacactcctggacccctgccgattctcaggctcccctctggggcaaagctgccctgacactgtctggtgtgcagcctgaggacgaggctgactatactncctatctacttgggtggtgtntgtgtgtgtcggacggacggacagctgaacgtcttagtcacgaccgagcgttccgccccgtcgtcctctctccgttcccctcccttccgtcc

SEQ ID NO: 358834 - DNA, 524 bp, Homo sapiens
  misc_feature: GZ8MTXP01A1SAK.17.33.C11.1.454.CMB.2.raw
  modified_base (270)..(270): a, c, t, g, unknown or other
  misc_feature (270)..(270): n is a, c, g, or t
  modified_base (473)..(473): a, c, t, g, unknown or other
  misc_feature (473)..(473): n is a, c, g, or t
  modified_base (503)..(503): a, c, t, g, unknown or other
  misc_feature (503)..(503): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccnggacaagcacccagggcactcatttatagtacaaacaacaaacactcctcggacccctgcccgattctcaggctccccctctggggcaaagctgccctgacactgtctgggtgtgcagcctgaggacgaggctagactattactgcctactcttacgtttggggtggtgctgtgctattcggcggaggaccagctgaaccgtnttaagtcagccaaggcttcgcccctggtcnctctcgttccctcccttctcc

SEQ ID NO: 358835 - DNA, 530 bp, Homo sapiens
  misc_feature: GZ8MTXP01EFE2M.17.33.C11.1.454.CMB.2.raw
  modified_base (385)..(385): a, c, t, g, unknown or other
  misc_feature (385)..(385): n is a, c, g, or t
  modified_base (519)..(519): a, c, t, g, unknown or other
  misc_feature (519)..(519): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcagactccccctccttgggggcaaagctcgccctgacactgtctggtntgcagcctgaggacgaggctagactattactgcctatctactttggggtgtgctgtgctattcggacggagggaccaagctgaacgtcttaaaggtcagcccaaggcttcgcccctcggcaactctcgttcccnccttccgtccc

SEQ ID NO: 358836 - DNA, 682 bp, Homo sapiens
  misc_feature: GZ8MTXP01EDIOA.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagacccctcacgctgacctgcaccttctctgcttctcactcagaacgagtggaatgggagtgggctggactccgcacgcccccgaggaacggccctggagtggcttgcgctctatttagtggatgagagtaagcactacagtcctctcgtagaagaacagctaccaaccatacaaccaaacggaaccaaccctccaaacaaaaccgagggttacggtaccttaacaaatacgaacctaaatacgtacggaccctgtacggaacacgacacccaatacttaactttactcgttacaacggtcttacgttagttcggggttacggggtaagttttaacgttaccggttcccttaacgttttacggtaaccgttaacgggtcgggggtaacccgttaagggggtaaacccttcggtacggggttacccttacccgggttccttaccccggcgtaccggtcccctacccgaaccggttaaaccggggccccttaacgtttcccccggg

SEQ ID NO: 358837 - DNA, 529 bp, Homo sapiens
  misc_feature: GZ8MTXP01AQ70Y.17.33.C11.1.454.CMB.2.raw
  modified_base (269)..(269): a, c, t, g, unknown or other
  misc_feature (269)..(269): n is a, c, g, or t
  modified_base (413)..(413): a, c, t, g, unknown or other
  misc_feature (413)..(413): n is a, c, g, or t
  modified_base (464)..(464): a, c, t, g, unknown or other
  misc_feature (464)..(464): n is a, c, g, or t
  modified_base (473)..(473): a, c, t, g, unknown or other
  misc_feature (473)..(473): n is a, c, g, or t
  modified_base (506)..(506): a, c, t, g, unknown or other
  misc_feature (506)..(506): n is a, c, g, or t
tcagcgtagactagcacgaccggtgctcgatttagagtgagctcgttgggtttggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccnggacaagcacccagggcactcatttatagtacaaacaacaaacactcctggacccctgcccgattctcaggctccccctccttgggggcaaagctgccctgacactgtctggtgtgcagcctgaggacgaggctgactattacngcctactctacttggggtgtgctgtgctagttcggcggagggcccaagccnggaaccgtnttaaggtcagcccaaggcttcgcccctcggtcnctctcgttcccgcccttcctccg

SEQ ID NO: 358838 - DNA, 547 bp, Homo sapiens
  misc_feature: GZ8MTXP01DYMCJ.17.33.C11.1.454.CMB.2.raw
  modified_base (316)..(316): a, c, t, g, unknown or other
  misc_feature (316)..(316): n is a, c, g, or t
  modified_base (395)..(395): a, c, t, g, unknown or other
  misc_feature (395)..(395): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaggccctggagtggcttgcgctcattatggatgagagtaagcatacagtcccgtntctgaagacaggctcaccatcaccaagacacctcacaaaccagtgtctacatgacatatgacctgtgacacagcccaanatatactcgttcgacgtcttctagtgggttacgggtagtttacgttacgtccttacgttacgtacgtacggtggggaccagggtacttcgtcggtccaccgttccttccgctacgtccgtacccgaccgaccggtaacccgttaaccgtccg

SEQ ID NO: 358839 - DNA, 531 bp, Homo sapiens
  misc_feature: GZ8MTXP01EP9HS.17.33.C11.1.454.CMB.2.raw
  modified_base (320)..(320): a, c, t, g, unknown or other
  misc_feature (320)..(320): n is a, c, g, or t
  modified_base (498)..(498): a, c, t, g, unknown or other
  misc_feature (498)..(498): n is a, c, g, or t
  modified_base (503)..(503): a, c, t, g, unknown or other
  misc_feature (503)..(503): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaggccctggagtggcttgcgctcatttatgggatgagagtaagcactacagtcccgtntctgaagacaggctccaccatcaccaaggaacacctcacaaacagtgtcctacaatgaccaatatggaccctgtggacacagccacatattactgttcacgtctctagtggttcggggattattacgtcctacttgactacgtggggccaggggaacttcgtaggtccaccggttccnccgcncgccctccaccgacggtcccttcgtccg

SEQ ID NO: 358840 - DNA, 564 bp, Homo sapiens
  misc_feature: GZ8MTXP01CWOML.17.33.C11.1.454.CMB.2.raw
  modified_base (269)..(269): a, c, t, g, unknown or other
  misc_feature (269)..(269): n is a, c, g, or t
  modified_base (418)..(418): a, c, t, g, unknown or other
  misc_feature (418)..(418): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaaccnggacaagcacccaggcactcatttatagtaacaaacaaacaaacactacctcggacccctgcccgattctcaggctcccccctccgttgggggcaaagctgcccctgacactgtctggtgtgcagcctgaggacgagctagactatacngcctactctacgtttggggtggttgtctgtgcgtagttcggacggagggtacccaaagccgtagccggtcttaaaggtcacgtcccaagggccttcgcccccctcggtccctaacttcctcgttccccgtccccttcccgttcccg

SEQ ID NO: 358841 - DNA, 534 bp, Homo sapiens
  misc_feature: GZ8MTXP01BBC1T.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttatgggatgagagtaagcactacagtccgtctctgaagaacaggctcaccatcaccaaggaacacctccacaaaccagtgtctacaatgaccatatgacctgtgacacagccacatatactgttcacgtctctagtggttcgggtagttagttacgtccttactttgacttacgtggggccaggggtacttcgtaggtcaccggttcttccgcacgcctccaccacgggtcccaagttccccgg

SEQ ID NO: 358842 - DNA, 518 bp, Homo sapiens
  misc_feature: GZ8MTXP01DLTAN.17.33.C11.1.454.CMB.2.raw
  modified_base (466)..(466): a, c, t, g, unknown or other
  misc_feature (466)..(466): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctgggatccgtcagccccaggaaaggccctggagtggcttgcgctcatttattgggatgagagtaagcactacagtccgtctctgaagaacaggctcaccatcaccaaggaacactccacaaaccagtgctacaatgaccaatatggaccctgtggacacagccacatattaactgttcacgctctatgttgggtggttattagtcctacttgtctaactgggcgnggaacgttcgtcgtcacgttcttcccgcncgccnccaccgacgtccgcgtcg

SEQ ID NO: 358843 - DNA, 781 bp, Homo sapiens
  misc_feature: GZ8MTXP01CPGZH.17.33.C11.1.454.CMB.2.raw
  modified_base (269)..(269): a, c, t, g, unknown or other
  misc_feature (269)..(269): n is a, c, g, or t
  modified_base (294)..(294): a, c, t, g, unknown or other
  misc_feature (294)..(294): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaaaccnggacaagcaccaggcactcatttanagtaacaaacaaacaaacactcctacggacccctgaccccgtattcctacgacggtccttacccccccgtccgttacggggggacctaaaacggcccgttaacggcccccttggaaccctaacgttcggttcctggggttcggtgccgtaacgcccgtaggaacgggacggaacgggccgttacggtaaccttaatttaaccgtcggtaccccttaacttccgtttaaccggtttttggggggttcgggtttcggtccgttgggttcggtaccgttaacggtttccgggggaccggggtaacgggggtaaccccgaaaaggtccgtaacgggtaaccccggtttacgttaaaacggttcccgaaacggtacccccggaaacgggccccgtttcccgggaccccccccggttttccggggacccctaaccccgtttcccgttcccggtttaccccccccgtaaccccgtttccccgtttaacccccgg

SEQ ID NO: 358844 - DNA, 537 bp, Homo sapiens
  misc_feature: GZ8MTXP01BHZVT.17.33.C11.1.454.CMB.2.raw
  modified_base (295)..(295): a, c, t, g, unknown or other
  misc_feature (295)..(295): n is a, c, g, or t
  modified_base (497)..(497): a, c, t, g, unknown or other
  misc_feature (497)..(497): n is a, c, g, or t
  modified_base (512)..(512): a, c, t, g, unknown or other
  misc_feature (512)..(512): n is a, c, g, or t
tcagcgtagactagcacgaccggtgctcgatttagagtgagctcgttgggtttgggggcgccaggggtcccttccaatatcagtaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcattanagtacaaacaacaaacactcctggacccctgcccgattcctcacggcctccctcccgttgggggcaaagctcgccctgaacactgtctggtgtgcagcctgaggacgaggctgactattactcgcctactctactttggtgggtgtctgtgctagttcggcggacgggacctaagctcgccgtctaagttcacgccaaggcncgccccttcggtccnctctcgtcccaccctccttctaacg

SEQ ID NO: 358845 - DNA, 546 bp, Homo sapiens
  misc_feature: GZ8MTXP01CS1DP.17.33.C11.1.454.CMB.2.raw
  modified_base (248)..(248): a, c, t, g, unknown or other
  misc_feature (248)..(248): n is a, c, g, or t
  modified_base (269)..(269): a, c, t, g, unknown or other
  misc_feature (269)..(269): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (288)..(289): a, c, t, g, unknown or other
  misc_feature (288)..(289): n is a, c, g, or t
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
  modified_base (346)..(346): a, c, t, g, unknown or other
  misc_feature (346)..(346): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctgganacggcacgacccaggaagccngagtgctgcntnattatgnngagagancatacacgtcgtncgtagaagacgngcaccacancaacaacgaaccaccnccaaacaaacgaggtacgtacctacaactacactaatagtacgaccgtacgacgacgacacacactatattactctacgactctctagtaggttacggtagttacgttacgtccttacttacgtacgtacgtcggcgacggtacgttcgtcgtcgttccgttcttccgcacgcctaccgaccgaccggtccgttcgtccg

SEQ ID NO: 358846 - DNA, 546 bp, Homo sapiens
  misc_feature: GZ8MTXP01AL5UH.17.33.C11.1.454.CMB.2.raw
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaggccctggagtggcttgcgctcatttattggatgagagtaagcactacagtccgtctctgaagaacaggctccaccatcacaagacacctcacaaaccngtgctanatgaccatanggacctgtgacacagccacatattactgttacacgcttcgtagtgggttcgggatttagttacgtcccttaatttcgacttacgtggggcccaggggtaccttcgtcgggtcacccggttcttcccgctacgccctacccgaccgacgggtccccaagttccccgg

SEQ ID NO: 358847 - DNA, 543 bp, Homo sapiens
  misc_feature: GZ8MTXP01ETI0X.17.33.C11.1.454.CMB.2.raw
  modified_base (269)..(269): a, c, t, g, unknown or other
  misc_feature (269)..(269): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggttccagcagaaaccnggacaagcacccagggcactcatttatagtacaaacaacaaacactcctagacccctgcccgattctcacggcctccccctccttgggggcaaagcctacgccctgacactgtctggtgtgcagcctgacggcgaggctgacttatactgcctactctactttgggggtgtgctgtgctagttcggcggagggaccaagctgaaccgtcttaagtcacgcccgaagcgttcgccccctcggcctaacgtctcgttcccctaacccttccgtccc

SEQ ID NO: 358848 - DNA, 540 bp, Homo sapiens
  misc_feature: GZ8MTXP01D1496.17.33.C11.1.454.CMB.2.raw
  modified_base (411)..(411): a, c, t, g, unknown or other
  misc_feature (411)..(411): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtaacaaaacaacaaacactcctcggacccctgcccgattctcacggcctcctccgtggggacaaaagctcgccctgacactgtctgggtgtgcagcctgaggacgaggcngactattactgcctacttcgttacgtttggtgtgtctgtgtctagttcggcggacggaccaagctgaccgtcttaaagtcacgcccgaaggcctccgcccctcggtccacgttctcgttccccgtcccc

SEQ ID NO: 358849 - DNA, 556 bp, Homo sapiens
  misc_feature: GZ8MTXP01DB8PC.17.33.C11.1.454.CMB.2.raw
  modified_base (317)..(317): a, c, t, g, unknown or other
  misc_feature (317)..(317): n is a, c, g, or t
  modified_base (432)..(432): a, c, t, g, unknown or other
  misc_feature (432)..(432): n is a, c, g, or t
  modified_base (520)..(520): a, c, t, g, unknown or other
  misc_feature (520)..(520): n is a, c, g, or t
  modified_base (527)..(527): a, c, t, g, unknown or other
  misc_feature (527)..(527): n is a, c, g, or t
  modified_base (537)..(537): a, c, t, g, unknown or other
  misc_feature (537)..(537): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatcgtcacgccccaggaagcctggagtggctgcgctcatttatggatgagagtaagcactacagtcccgtcncgtagaagaacaggctccaccatcaaccaaggaaccaccctccaacaaacccagggtacggtacccttaacaatcgaaccctaaatactcgggaacccttgacggaacaccgaanaccatatattacgtgtacgacgtctcgtaggtcggttaggtattacgttacgtccttagttgacgtggcggcaggtacttcgtcgtcnccgttcnccgcacgccnccaccgacgtccgcgtccg

SEQ ID NO: 358850 - DNA, 536 bp, Homo sapiens
  misc_feature: GZ8MTXP01B6EBS.17.33.C11.1.454.CMB.2.raw
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (421)..(421): a, c, t, g, unknown or other
  misc_feature (421)..(421): n is a, c, g, or t
  modified_base (498)..(498): a, c, t, g, unknown or other
  misc_feature (498)..(498): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccnggacaagcacccagggcactcatttanagtacaaacaacaaacactcctggaccccctgccccgattcctcaggcctcccccctccttgggggcaaagctagccctgacactgtctggtgtgcagcctggaggacgaggctgactattacngcctactctactttggggtgtgctgtgctagttcggcggtagggaccaagctgaaccgtcttaagtcagcccaagcncgcccctggccaactctcgttcccaacccttcctcccg

SEQ ID NO: 358851 - DNA, 588 bp, Homo sapiens
  misc_feature: GZ8MTXP01A8VSM.17.33.C11.1.454.CMB.2.raw
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
  modified_base (422)..(422): a, c, t, g, unknown or other
  misc_feature (422)..(422): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccnggacaagcaccaggcactcatttanagtaacaaacaaacaaacactcctcggacccctgcccgattctacacggcctcccccctccgttgggggacaaacgcctcgccctgacactgtctggtgtgcagcctgaggacgagctgactatacngcctactctactttggggtgtgtcgtgtgctagttcggacgggtcggaaccgaagtcgtacggaaccgttcttaaagtccacgccccgtaaaggcccgttccggcccccgtcgggtccctaaccgttccgttccggttaccccctaacccccgttcccgttccccg

SEQ ID NO: 358852 - DNA, 524 bp, Homo sapiens
  misc_feature: GZ8MTXP01DPZTI.17.33.C11.1.454.CMB.2.raw
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
  modified_base (519)..(519): a, c, t, g, unknown or other
  misc_feature (519)..(519): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaaggccctggagtggcttgcgctcatttatgggatgagagtaagcactacagtccgtctctgaagaacagctccacatcacaagaaccacctccaacaaaccaggtcgtaccttacaaatgaccaaatatcggaccctgtggacacagccaacataattactgttcacgctctatggtcgggattattagtccctatttgactagtgggccagggacttgtggtcaccgttcnccgcncgcctcaccgacggtcccngtccg

SEQ ID NO: 358853 - DNA, 532 bp, Homo sapiens
  misc_feature: GZ8MTXP01A3NW6.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctccaccatcaccaagaacacctcacaaaccaggtcgtaccttacaatgaaccaatatggaccctgtggacacagccacatattactgttcacgctctatggtcggattattagtcctactttgacctacgtggggccagggaacttgtagtcaccgttcttccggcagccctccacaacgggtcccaagttcccgg

SEQ ID NO: 358854 - DNA, 532 bp, Homo sapiens
  misc_feature: GZ8MTXP01BJY0A.17.33.C11.1.454.CMB.2.raw
  modified_base (322)..(322): a, c, t, g, unknown or other
  misc_feature (322)..(322): n is a, c, g, or t
  modified_base (375)..(375): a, c, t, g, unknown or other
  misc_feature (375)..(375): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccgtcagcccccaggaaaggccctggagtggcttgcgctcatttattgggatgagagtaagcactacagtccgtntctgaagaacaggctcaccatcacaaggaacacctcacaaaccagtgtcctanaatgaccaatatggaccctgtggaacacagccacatattactgttcacgtctctagtggttcggggagttattagtccctatttgactacgtggggccaggggtacttcgtgggtcaccggttcttccgcagcctccaccaagggcccaagtcccgg

SEQ ID NO: 358855 - DNA, 543 bp, Homo sapiens
  misc_feature: GZ8MTXP01D8D1N.17.33.C11.1.454.CMB.2.raw
  modified_base (186)..(186): a, c, t, g, unknown or other
  misc_feature (186)..(186): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctnacgctgacctgcaccttctctggcttctcactcagaacgagtggaatgggagtgggctggatccgtcagccccaggaaggccctggagtggcttgcgctcatttatgggatgagagtaagcactacagtccgtctctgaagaacaggctccaccatcaccaaggaaccacctccacaaaccaggtcgtaccttacaatcgaccaatatgaccctgtcgacacagccacatattactgttcacgtctctagtgggttcgggattattacgtcctatttgactcgtggggccagggaccttcgtggtccaccggttcttcccggcacgccctccgaccaacgggtcccaagttccccgg

SEQ ID NO: 358856 - DNA, 545 bp, Homo sapiens
  misc_feature: GZ8MTXP01DGJP4.17.33.C11.1.454.CMB.2.raw
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (376)..(376): a, c, t, g, unknown or other
  misc_feature (376)..(376): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (411)..(411): a, c, t, g, unknown or other
  misc_feature (411)..(411): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtcggggctgggactaccggtcacgacccctaggaaggccctggagtggcttgcgctcatttattgggatgagagtaagcactacagtccgtctctgaagaacaggctccacatcacagacacncanaaacngtgctanatgacatatgaccngtganacanacacatatactntcgtctctctagtggttggtagttagttacgtccttacttacgtacgtcgtcgggtcggacggtacgttcgtcgtcgttaccgttccgttccgtccgacgtccgtcccgaccgaccggtaacccgttccgtccg

SEQ ID NO: 358857 - DNA, 543 bp, Homo sapiens
  misc_feature: GZ8MTXP01CJTWF.17.33.C11.1.454.CMB.2.raw
  modified_base (395)..(395): a, c, t, g, unknown or other
  misc_feature (395)..(395): n is a, c, g, or t
  modified_base (448)..(448): a, c, t, g, unknown or other
  misc_feature (448)..(448): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctccaccatcaccaaggaaccacctcccaacaaaccaggtgtccttacaatgaccaatanggaccctgtggacacagccacatattactgttcacgctctagtggttcggggnttattagtccctatttgactcgtggggtcaggggtacttcgtgggtcaccgttcttccgctacgcctcccaccgaacgggccccaagttccccgg

SEQ ID NO: 358858 - DNA, 550 bp, Homo sapiens
  misc_feature: GZ8MTXP01D1IRD.17.33.C11.1.454.CMB.2.raw
  modified_base (226)..(226): a, c, t, g, unknown or other
  misc_feature (226)..(226): n is a, c, g, or t
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggttccagcagaaaccnggacaagcacccaggcactcatttanagtacaaacaacaaacactcctgacccctgcccgattctcaggcctccccctccgttgggggcaaagctcgccctgacactgtctggtgtgcagcctgaggacgaggctgactattactgcctactcttacgtttggggtggtgcttgtgctagttcggtcggaggaccaagcgtgaaccgtcttaagtcacgacccgaaggccgttcgccccgtcggtcaaccttctccgttccccgtcccttcccgttcccg

SEQ ID NO: 358859 - DNA, 544 bp, Homo sapiens
  misc_feature: GZ8MTXP01EBZ7P.17.33.C11.1.454.CMB.2.raw
  modified_base (321)..(321): a, c, t, g, unknown or other
  misc_feature (321)..(321): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (444)..(444): a, c, t, g, unknown or other
  misc_feature (444)..(444): n is a, c, g, or t
  modified_base (461)..(461): a, c, t, g, unknown or other
  misc_feature (461)..(461): n is a, c, g, or t
  modified_base (474)..(474): a, c, t, g, unknown or other
  misc_feature (474)..(474): n is a, c, g, or t
  modified_base (535)..(535): a, c, t, g, unknown or other
  misc_feature (535)..(535): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgtcagccccaggaaggccctggagtggcttgcgctcatttatgggatgagagtaagcactacagtcccgtntctagaagaacaggctaccaccatcaccaacggaaccacctccaaacaaacccgaggtacgtaccttaacaatacgaccaatatcggacccttgagaacacganccanatattactgtcacgntctagtggtcggatttntacgtccttattnactctggggccagggtacttcgtgtcaccgttcttccgcacgcctccaccgacgggtcccngttccccgg

SEQ ID NO: 358860 - DNA, 620 bp, Homo sapiens
  misc_feature: GZ8MTXP01D2XYI.17.33.C11.1.454.CMB.2.raw
  modified_base (293)..(293): a, c, t, g, unknown or other
  misc_feature (293)..(293): n is a, c, g, or t
tcagcgtagactagcacgaccggtgctcgatttagagtgagctcgttgggtttgggggcgccaggggtcccttccaatatcagtaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaaacctggacaagcaccaggcactcattanagtaacaaacaacaaacactctacggacccctgcccgattctcacggctccctcccgtgggggacaaagctcgccctgcactgtctggtgtgcgacgcctgaggacgaggctagacttattactgccttactcttactttgggtggggtcgtcgttgtcgtctacgttcgggacggaacggggtacccaaaggtcgtcggaacccgttaacgtttaaacgccgtaacgacccgaaacggggtcccttcccgggttccccccgttacgggtccctaacccgttcccttccggttaccccccacccctttcccttcccgtttaacccgg

SEQ ID NO: 358861 - DNA, 608 bp, Homo sapiens
  misc_feature: GZ8MTXP01ANXF6.17.33.C11.1.454.CMB.2.raw
  modified_base (322)..(322): a, c, t, g, unknown or other
  misc_feature (322)..(322): n is a, c, g, or t
  modified_base (371)..(371): a, c, t, g, unknown or other
  misc_feature (371)..(371): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaacggccctggagtggcttgcgctcatttagtggatgagagtagcactacagtccgtntctagaagacaggctccaccatcaaccaaggaacaccctcaacaaaccngggtcgtaccttaacgaattcgaaccaatacgtacggaccctaggtcgggaaccacgacgccccaataattacttactaggtttcaacgtcgttcctaagttcgggttcggggttacgttacgtttagttcccgttaccgtttagtaccgttacgtcggggtacgacgggtaaccttcgtcgtcgttacccgttcttcccggtcacggccctaccaccgaccgtcccgcgttcccgg

SEQ ID NO: 358862 - DNA, 573 bp, Homo sapiens
  misc_feature: GZ8MTXP01AI96G.17.33.C11.1.454.CMB.2.raw
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
  modified_base (422)..(422): a, c, t, g, unknown or other
  misc_feature (422)..(422): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacnggacaagcacccaggcactcatttanagtaacaaacaacaaacactcctggacccctgcccgattctcaggcctcccccgtccgttgggggacaaacgctacgccctgacactgtctggtgtgcacgcctggaggacgaggctagactattacngtcctactcttacgttggggtgtgtctggtgtctagttcggcgggagggtaccaaggctgaaccgtcgttaacgtcgacgacccgaaggttcccgttcggttccccctcggtcctccttcctccgttcccctaacccgttcccttaacccg

SEQ ID NO: 358863 - DNA, 567 bp, Homo sapiens
  misc_feature: GZ8MTXP01BF9VA.17.33.C11.1.454.CMB.2.raw
  modified_base (539)..(539): a, c, t, g, unknown or other
  misc_feature (539)..(539): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtaacaaacaacaaacactacctggaccccctgccccgattcctcacggcctccccccgtccttgggggcaaagcctcgccctgacactgtctggtgtgcagcctggaggacgaggctagactatactgcctactcttacgttggggtgttgtcgtgtgtcgttagttcggacgggtaggtaccgaagctggaaccgttcttaagtcttacgcccgaaggccgttcgcccccgtcggtacncctcgtcgttccccgcccgttcctcccg

SEQ ID NO: 358864 - DNA, 601 bp, Homo sapiens
  misc_feature: GZ8MTXP01DQQKK.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccgtcacgccccaggaacggccctggagtggcttgcgctctatttattgggatgagagtaagcactacagtccgtctctagaaagaacaggcctaccaccatccaaccgaaacggaaccaacctccaaacaaacccgagggtcgtaccttaacgaatcgaaccaatactcggaccctgtacggaacacagcccatatacttactcgttacacgtcttctagtgggttcgggagtttagttacgttcccttactttgaccgtcggtggggaccttaggggtaacttcgtcgggtccaccggttccttacccggctaacgccctaccgaccgaacgggtccccaacgttccccgg

SEQ ID NO: 358865 - DNA, 594 bp, Homo sapiens
  misc_feature: GZ8MTXP01ATYY2.17.33.C11.1.454.CMB.2.raw
  modified_base (336)..(336): a, c, t, g, unknown or other
  misc_feature (336)..(336): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctgacccctgcccgattcncacggctccccctccttggggcaaagctcgccctgacactgtctggtgtgcagccgtgagggacgaggctaggactattactgcctactcttacgtttggggtggtgtctgtgtctagttcggcgggtacgggaccgaagcgtcggaacccgttcgttaacggtcgacggaccccgaaagggcccttccggccccccgttccggggtccctaaccgttcccgttccggttcccccgtccccgtttcccgttaaccccg

SEQ ID NO: 358866 - DNA, 579 bp, Homo sapiens
  misc_feature: GZ8MTXP01DFKFT.17.33.C11.1.454.CMB.2.raw
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
  modified_base (390)..(390): a, c, t, g, unknown or other
  misc_feature (390)..(390): n is a, c, g, or t
  modified_base (419)..(419): a, c, t, g, unknown or other
  misc_feature (419)..(419): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccnggacaagcaccaggcactcatttanagtacaaacaacaaacactcctggacccctgccccgtattcctcaggctcccccctccgttgggggacaaagctacgccctgacactgtctggtntgcagcctggagacgagctagactatacngcctactcttacgttggggtggtgcgtgtagtctagttccgggacggtacgggacccaaagccgtgtaacccgttgttaaacgtcgacggacccaaagggccttcgcccccctaacgggtccaaccttccgtccgttcccccgtccccttcccgttcccg

SEQ ID NO: 358867 - DNA, 570 bp, Homo sapiens
  misc_feature: GZ8MTXP01BWI6A.17.33.C11.1.454.CMB.2.raw
  modified_base (399)..(399): a, c, t, g, unknown or other
  misc_feature (399)..(399): n is a, c, g, or t
  modified_base (424)..(424): a, c, t, g, unknown or other
  misc_feature (424)..(424): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaacggcctggagtggcttgcgctctatttatggatgagagtaagcactacagtccgtctctagaagacaggctaccacatacaccaaggaaccacctccaacaaaccgaggtcgtacctacaatcgacctaatacncggaccctgtacggacacacgccanatattactgttcacgtctctacgttgggttcgggtagtttattacggtccccttagtttgacctaggtcgggacaggggtaacttcgtcggtccaccgttccttccgcacgccctaccgaccgaacgggtccccaacgttccccgg

SEQ ID NO: 358868 - DNA, 560 bp, Homo sapiens
  misc_feature: GZ8MTXP01BPL7N.17.33.C11.1.454.CMB.2.raw
  modified_base (270)..(270): a, c, t, g, unknown or other
  misc_feature (270)..(270): n is a, c, g, or t
  modified_base (534)..(534): a, c, t, g, unknown or other
  misc_feature (534)..(534): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccnggacaagcacccagggcactcatttatagtaacaaacaacaaacactcctggaccccctgcccgattctcacggctccccctccttgggggcaaagctacgccctgacactgtctggtgtgcagccgtgaggacgaggctaggactattaacgtgacctactcttacgtttggggtggttgtctgtgtctagttcgggacggtaggggtaccaacgcgtggaaccgttcttaagtcacgcccaaggccgttcgcccctcggtcnctctcgttccctaacccttcctcccg

SEQ ID NO: 358869 - DNA, 574 bp, Homo sapiens
  misc_feature: GZ8MTXP01CSERT.17.33.C11.1.454.CMB.2.raw
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtggggctggactacggcacgccccaggaaggccctggagtggcttgcgctcatttattgggatgagagtaagcactacagtcccgttctcgtgaagaaacgngctaccacacncaaccaacgaaccacctccaacaaaccgacggtacgtacctacatacacaatagtacgtacgtgacgacacacacacactactactcgtacgtacgtctctagtggttcgggtagttacgttacgtccgttacgttacgtacgtacgtcgggcggacggtacgttcgtcgtcgttccgttcgttccgcgcgtccgcccgaccgaccggtaaccgttccgtccg

SEQ ID NO: 358870 - DNA, 554 bp, Homo sapiens
  misc_feature: GZ8MTXP01CKKT1.17.33.C11.1.454.CMB.2.raw
  modified_base (225)..(225): a, c, t, g, unknown or other
  misc_feature (225)..(225): n is a, c, g, or t
  modified_base (269)..(269): a, c, t, g, unknown or other
  misc_feature (269)..(269): n is a, c, g, or t
  modified_base (494)..(494): a, c, t, g, unknown or other
  misc_feature (494)..(494): n is a, c, g, or t
  modified_base (527)..(527): a, c, t, g, unknown or other
  misc_feature (527)..(527): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggancagtcaccagtgcttactatccaaactggttccagcagaaaccnggacaagcacccagggcactcatttaatagtaacaaacaacaaaacactacctcggaccccctgccccgtattcctacacggcctccccccctccgttagggggaccaaagcctacgccctgacactgtctggtgtgcagcctgaggcgagctagactattactgcctactcttacgtttggggtgtgtctgtgctagttcggacggacggacagctgaaccgtnttagtcacgcccaggccttcgcccctcggtccnctcctcgttcccgtcccttccgtcccg

SEQ ID NO: 358871 - DNA, 567 bp, Homo sapiens
  misc_feature: GZ8MTXP01E0MZJ.17.33.C11.1.454.CMB.2.raw
  modified_base (321)..(321): a, c, t, g, unknown or other
  misc_feature (321)..(321): n is a, c, g, or t
  modified_base (418)..(418): a, c, t, g, unknown or other
  misc_feature (418)..(418): n is a, c, g, or t
  modified_base (529)..(529): a, c, t, g, unknown or other
  misc_feature (529)..(529): n is a, c, g, or t
  modified_base (534)..(534): a, c, t, g, unknown or other
  misc_feature (534)..(534): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctgggactccgcagcccccaggaaggccctggagtggcttgcgctcatttatgggatgagagtaagcactacagtccgtntctagaagaacaggctccaccatcaccaaggaaccacctccaacaaaccaggtcgtaccttacaatgaccaatatggaccctggtgacacagcccanatattactgttacacgtctctaagtgggttcgggtagtttattaacggtccccttaatttcgacttacgtggggcccaggggtaaccttcgtacgggtcaaccggttcccnccgcnccgtcccacccgaccgaccggtcccttcgtccg

SEQ ID NO: 358872 - DNA, 538 bp, Homo sapiens
  misc_feature: GZ8MTXP01EAKUB.17.33.C11.1.454.CMB.2.raw
  modified_base (404)..(404): a, c, t, g, unknown or other
  misc_feature (404)..(404): n is a, c, g, or t
  modified_base (493)..(493): a, c, t, g, unknown or other
  misc_feature (493)..(493): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaagcctggagtggcttgcgctcatttattgggatgagagtaagcactacagtccgtctctgaagaacaggctccaccatcaccaagaacacctcacaaaccagtgtcctacaatgaccaatatggaccctgtgacacagccaanatatactctacgacgtctcgtagtggttcgggtagtttagttacgtccttacttagtactcggtcgggcgagggtacttcgtcggtccnccgttccttccgcacgcccacccgaccgacggtcccttcgtcccg

SEQ ID NO: 358873 - DNA, 587 bp, Homo sapiens
  misc_feature: GZ8MTXP01B1M5J.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaacggccctggagtggcttgcgctctatttagttgggatgagagtaagcactacagtcccgtctctagaagaacaggctccaccatcaccaagaaccacctccaacaaaccaggtcgtaccttacaatacgaccaatactcggaccctgtaggacacacgaccacatacttactgttcacgtcttctagttcgggttcgggtagtttattacgtcccttacgtttagaccttcgtcggggccgttaggggtaaccttcgtacggtcacccggttccttaccggcaccgccctaccgaccgaacgggtcccttaacgttccccgg

SEQ ID NO: 358874 - DNA, 625 bp, Homo sapiens
  misc_feature: GZ8MTXP01DXDMN.17.33.C11.1.454.CMB.2.raw
  modified_base (590)..(590): a, c, t, g, unknown or other
  misc_feature (590)..(590): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaacggccctggagtggcttgcgctctatttagttgggatgagagtaagcactacagtccgtctctagaagaacaggcctaccaccataccaaccaaacggaacccaaccctccaaaccaaaccgagggtacggtaccttaacaactacgaaccctaagtacgtcgggaccccttggacggaaccacgacgccaaactattaatttaacctgtttaccaacgtcttcgttaagttggggttaccggggtatttacttaacggttccccttaagtttcgacttcggtcggggacccttaggggtaacttcgtacggtccaccggttcccnccgcaccgccctaccgaccgacgtccttcgtcccg

SEQ ID NO: 358875 - DNA, 613 bp, Homo sapiens
  misc_feature: GZ8MTXP01C8X2B.17.33.C11.1.454.CMB.2.raw
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatcccaaatggttccagcagaaacctggacaagcacccagggcactcatttanagtacaaacaacaaacactcctggacccctgcccgattcncaggcctccccctccgttgggggctaaagctcgccctgacactgtctgatcggtgcagcctgacggaccgaagggcctgactattactgcctactcttacggtttggtgggtgtcgttgtagcgttaagttcgggcggagggtacccaaggccttggaacccgttcgtttaaacgttccgtaacggtcccccgaaacgggccttcccggtcccccccgttcggggttcccctaacccttcccgttccgtttccccccggttcccccgttttcccccg

SEQ ID NO: 358876 - DNA, 608 bp, Homo sapiens
  misc_feature: GZ8MTXP01AE8R5.17.33.C11.1.454.CMB.2.raw
  modified_base (325)..(325): a, c, t, g, unknown or other
  misc_feature (325)..(325): n is a, c, g, or t
  modified_base (389)..(389): a, c, t, g, unknown or other
  misc_feature (389)..(389): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtggggctggactccgtcacgcccccaggaaaggccctggagtggcttgcgctcatttatgggatgagagtaagcactacagtccgtntctagaagaacaggctccaccatcaaccaaggaaccacctcaacaaacccaggtcgtaccttanaatcgaaccaatagtcggaccctgtacggacacacgaccacatattactgttacacgtctcgtagttcgggtcggggtattagttacgtcccttagtttagaccttacggtggggcccgaaggggtaaccttcgtacgggtcccttaacccggttcccgttcccgaaccgtaccgtccccgtacccgaacccggaccggtccccgttaacggtccccgg

SEQ ID NO: 358877 - DNA, 528 bp, Homo sapiens
  misc_feature: GZ8MTXP01BM2QF.17.33.C11.1.454.CMB.2.raw
  modified_base (383)..(383): a, c, t, g, unknown or other
  misc_feature (383)..(383): n is a, c, g, or t
  modified_base (433)..(433): a, c, t, g, unknown or other
  misc_feature (433)..(433): n is a, c, g, or t
  modified_base (496)..(496): a, c, t, g, unknown or other
  misc_feature (496)..(496): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatcgtcagccccaggaagcctggagtggcttgcgctcatttatgggatgagagtaagcactacagtccgtctctagaagaacaggctccaccatcaccaacgaaccacctccaacaaaccaggtcgtaccttacaatnaccaatactcggacctgtaggacacacgcacatattactgttcacgtctntagtggttcgggtattagttacgtcctattgacgtgtcggggcaagggtacttcgtggtcccncgttcncncncnccncaccgacgtccgcgtcg

SEQ ID NO: 358878 - DNA, 530 bp, Homo sapiens
  misc_feature: GZ8MTXP01C4QDL.17.33.C11.1.454.CMB.2.raw
  modified_base (296)..(296): a, c, t, g, unknown or other
  misc_feature (296)..(296): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggttccagcagaaacctggacaagcacccagggcactcatttanagtacaaacaacaaacactcctggacccctgcccgattctcagctccccctccttgggggcaaagctgccctgacactgtctgggtgtgcagcctggaggacgaggctgacttattactgcctactctactttggggtcgtgtctgtgtctagttcggcggagggaccaagctgaacgtcttaagtcagcccaaggcttcgcccctcggtcaactctcttcccgcccttcctcc

SEQ ID NO: 358879 - DNA, 697 bp, Homo sapiens
  misc_feature: GZ8MTXP01EUCR6.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccgaggaaacggccctgggagtggcttgcgctctatttagtgggatgagagtaagcactacagtcccgtctacgtagaaagaacaggcctacccaccataccaacccgaaacggaacccaccctccaaacaaaacccgacgggttacggtacccttaacaaagtacgaacctaaagtacgtacgggaacccctggtacggaaccacgaacgaccctaaactaacttaactttaacctcggtttaccgaaacggttaccttccgttaaaggtttcgggggtttaccgggggtaattttaacgtttaaccggtttccccttaacgttttcggaaccgttaacggtcgggggtaccgttaaaggggtaaccttcgtcgggtaccaccggttccgttcccgcctacgccctaccgaaccgacgggtcccttaacgttccccgg

SEQ ID NO: 358880 - DNA, 641 bp, Homo sapiens
  misc_feature: GZ8MTXP01AOX99.17.33.C11.1.454.CMB.2.raw
  modified_base (391)..(391): a, c, t, g, unknown or other
  misc_feature (391)..(391): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaacggccctggagtggcttgcgctcatttatggatgagagtaagcaactacagtccgtctctagaagaacaggctaccaccatccgaaccaaggaaccaccctccaacaaaccgaggtcgtaccttanaatcgaaccaatatcggaccctgtacggaacacagccaacataacttactgttccaacgtctaccgtagtcgggttacggggtatttacgttaacgtcccttaacgtttcgaaccttacggttaacgggggaccttaagggggtaaaccttcggttacggttcccgaaccccggttcgttaccccgaaccgaccgtccccgttaccccgaacccgttaaccgggggtcccccttaacggtttcccccggg

SEQ ID NO: 358881 - DNA, 592 bp, Homo sapiens
  misc_feature: GZ8MTXP01BFXF8.17.33.C11.1.454.CMB.2.raw
  modified_base (270)..(270): a, c, t, g, unknown or other
  misc_feature (270)..(270): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcagaaacnggacaagcaccaggcactnattanagtacaaacaacaaacactcctacggacccctgcccgattcctcacggcctccccctccgttgggggacaaagctcgccctgacactgtcgtggtgtgcagcctggaggacgaggctagactattactgcctactcttacgtttggggtcgtgtcgtgtcgtcgtagttcgggcgggacgggtaccgaagtccgtcggtaaccgttacgttaaacgtccgacgtaccccgaagggcccgttccggccccctccgggtacctccttccgtccgttccccgtccccttcccgttaacccg

SEQ ID NO: 358882 - DNA, 669 bp, Homo sapiens
  misc_feature: GZ8MTXP01CGY21.17.33.C11.1.454.CMB.2.raw
  modified_base (213)..(213): a, c, t, g, unknown or other
  misc_feature (213)..(213): n is a, c, g, or t
  modified_base (228)..(228): a, c, t, g, unknown or other
  misc_feature (228)..(228): n is a, c, g, or t
  modified_base (300)..(300): a, c, t, g, unknown or other
  misc_feature (300)..(300): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtncttccaacactggancagtcaccagtgtcttactataccaaactggttcccagcagaaacctggacaagcaccaggcactcatttanagtaacaaacaacaaacactcctcggacccctcgacccgattcctacgacgcctaccccccgtccggttacgggggacaaacgccttacggccctcgacacgttcgtcgtggtcgtgcacgccgtaggacgggacgaggaccgtagtacttattacgtacgtacccttaacttcgtttaccgtttgggggttcggttcggtccgttggtcgtacgttaacggttcgggacggggacgggaaccgacgtccgtcggtaacccgttcgttaaacggtccgacggtaccccgaaggttcccgttccggttccccccggttcggtccctaaccgttccttcccgttcccctaaccccgttccctttaaccccg

SEQ ID NO: 358883 - DNA, 561 bp, Homo sapiens
  misc_feature: GZ8MTXP01DFURY.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattcctcaggcctccccctccgttgggggcaaagctcgccctgacactgtctggtgtgcagcctggaggacgaggctagactattactcgcctacttcttacgtttgggggtcggtgtctgtgtcgtagttcgggacggtagggaccaagcgtgaaccgttcttaaagtcacgtcccgaaggccgttcgcccctcggtcaacttctacgttccctaacccttcctcccg

SEQ ID NO: 358884 - DNA, 676 bp, Homo sapiens
  misc_feature: GZ8MTXP01AZFQE.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtgggagtgggctggactccgtcacgccccgaggaacggcctggagtggcttgcgctctatttagtggatgagagtagcactacagtccgtctcgtagaagaacgagctacccaccataccaaccgaacggaacccaccctaaccaaaccaaaccgtacgggtacgtaccttaacaatacgaaccctaaatacgtacgggaccctaggtacggaaccacgacgacccaactattaacttacttcggttaccaacggtcttacgttaaggttcggggtttccgggggtaatttacgtttaccggttccctttacgtttaggaccgttacgggtcgggggaccgttaaggggtaaccttccggttacggtccaccccggttccttcccggctaccggtcccctacccgacccggttaacccgggtccccttaacggtttcccccggg

SEQ ID NO: 358885 - DNA, 537 bp, Homo sapiens
  misc_feature: GZ8MTXP01AZVKC.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttacatccaaactggttccagcagaaacctggacaagcacccagggcactcatttatagtacaaacaacaaacactcctggacccctgcccgattctcaggctccccctcttgggggcaaagctgccctgacactgtctggtgtgcagcctggaggcgaggctgactatactgcctaactcttacttggggtggtgctgtgccgtagttcggcggagggaccaaggctggaaccgttcttaaagtcagcccaaggccttcgcccctggtccaactctcgttcccgtccttccgttcccg

SEQ ID NO: 358886 - DNA, 582 bp, Homo sapiens
  misc_feature: GZ8MTXP01E0NT1.17.33.C11.1.454.CMB.2.raw
  modified_base (363)..(363): a, c, t, g, unknown or other
  misc_feature (363)..(363): n is a, c, g, or t
  modified_base (387)..(387): a, c, t, g, unknown or other
  misc_feature (387)..(387): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
  modified_base (542)..(542): a, c, t, g, unknown or other
  misc_feature (542)..(542): n is a, c, g, or t
  modified_base (549)..(549): a, c, t, g, unknown or other
  misc_feature (549)..(549): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtggggagtggggctgggactaccggtcgacgaccccgaaggaacggccctggagtggcttgcgctcatttagttgggatgagagtaagcactacagtcccgtctcgtagaaagaacaggcctacccaccanaccgaaccaaacggaacccacccnccaaacaaaccgagggtcgtaccttaacaatgaaccaatatcggacctgngacananccanatattactgttcacgtctgttagtgggttcgggtatttattaacgtcccttaatttgaacttcgcgggggccttaggggacttcgtcggtcccnccgttcnccgcacgccgccgaccgaccgtccgttcgtccg

SEQ ID NO: 358887 - DNA, 333 bp, Homo sapiens
  misc_feature: GZ8MTXP01D9PHF.17.33.C11.1.454.CMB.2.raw
  modified_base (213)..(213): a, c, t, g, unknown or other
  misc_feature (213)..(213): n is a, c, g, or t
  modified_base (266)..(291): a, c, t, g, unknown or other
  misc_feature (266)..(291): n is a, c, g, or t
  modified_base (293)..(333): a, c, t, g, unknown or other
  misc_feature (293)..(333): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttcncactcagaacgagtggaatggggagcggggctggacaacggcacacctaaggnnnnnnnnnnnnnnnnnnnnnnnnnncnnnnnnnnnnnnnnnnnnnnnnnnnnnnnnnnnnnnnnnnn

SEQ ID NO: 358888 - DNA, 548 bp, Homo sapiens
  misc_feature: GZ8MTXP01ANILK.17.33.C11.1.454.CMB.2.raw
  modified_base (225)..(225): a, c, t, g, unknown or other
  misc_feature (225)..(225): n is a, c, g, or t
  modified_base (293)..(293): a, c, t, g, unknown or other
  misc_feature (293)..(293): n is a, c, g, or t
  modified_base (316)..(316): a, c, t, g, unknown or other
  misc_feature (316)..(316): n is a, c, g, or t
  modified_base (482)..(482): a, c, t, g, unknown or other
  misc_feature (482)..(482): n is a, c, g, or t
  modified_base (521)..(521): a, c, t, g, unknown or other
  misc_feature (521)..(521): n is a, c, g, or t
  modified_base (536)..(536): a, c, t, g, unknown or other
  misc_feature (536)..(536): n is a, c, g, or t
tcagcgtagactagcacgaccggtgctcgatttagagtgagctcgttgggtttgggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttacatccaaactggttccagcagaaacctggataagcaccaggcactcatttanagtaacaaacaacaaacactccnggacccctgcccgtattctcacggcctccccctccgttgggggacaaagctacgccctgacactgtctggtgtgcacgcctggaggacgaggctagactattactgcctactctactttggggtgtgctgtgctagttcggacggaggtaccaagcgtgaaccgtnttacgtcacgtacccgaaggcgttcgcccccgtggtccnctcctcgttaccccnccttccctcccg

SEQ ID NO: 358889 - DNA, 548 bp, Homo sapiens
  misc_feature: GZ8MTXP01E0C6Z.17.33.C11.1.454.CMB.2.raw
  modified_base (270)..(270): a, c, t, g, unknown or other
  misc_feature (270)..(270): n is a, c, g, or t
  modified_base (518)..(518): a, c, t, g, unknown or other
  misc_feature (518)..(518): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccnggacaagcaccaggcactcatttatagtacaaacaacaaacactcctcggacccctgcccgattctcaggcctccccctccgttgggggcaaagctgccctgacactgtctggtgtgcagcctggaggacgaggctgactatactgcctactcttacttgggggtgtgctgtcgctagttcggcgggaggaccaaggctcggaaccgtcttaagcttacgcccgaacggcgttcgcccccgtggtccncctcgtccgttccccgcccttcccgtcccg

SEQ ID NO: 358890 - DNA, 573 bp, Homo sapiens
  misc_feature: GZ8MTXP01EXKQD.17.33.C11.1.454.CMB.2.raw
  modified_base (505)..(505): a, c, t, g, unknown or other
  misc_feature (505)..(505): n is a, c, g, or t
  modified_base (538)..(538): a, c, t, g, unknown or other
  misc_feature (538)..(538): n is a, c, g, or t
  modified_base (543)..(543): a, c, t, g, unknown or other
  misc_feature (543)..(543): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaacggccctggagtggcttgcgctcatttatggatgagagtaagcactacagtcccgtctctagaagaacaggcctacccaccataccaaccaacggaaccaccctccaacaaacccgagggtcgtacccttaacaatacgaaccaatacgtcgggaccctgtacggacacagccatatacttaactgttacacgtctcttagtgggttacgggtatttattacgtccctattcgactacgnggggccaggggtacttgtacggtcaccgttccnccgcncgccctccgaccgacggtcccttcgtcccg

SEQ ID NO: 358891 - DNA, 621 bp, Homo sapiens
  misc_feature: GZ8MTXP01CFTDA.17.33.C11.1.454.CMB.2.raw
  modified_base (276)..(276): a, c, t, g, unknown or other
  misc_feature (276)..(276): n is a, c, g, or t
  modified_base (303)..(303): a, c, t, g, unknown or other
  misc_feature (303)..(303): n is a, c, g, or t
  modified_base (476)..(476): a, c, t, g, unknown or other
  misc_feature (476)..(476): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtcaccagtcgcttactataccaaactcggtccagacaacgaaaccnggaacaagcacccaggcactcatttanagtaacaaacaacaaacactacctcggaccctcgccgtattcacacgcctcccccgtcgtggggacaaagctacgccctgactactgtctggtcgtgctacgccgtaggacggacgaggtctagtacttattactcgtcctactcgttacgtttgggggtggtcgtcgtggtntcgttacgttcgggacgggacggtacccgaagtccgtcggtaaccgttacttaagccgacggacccgtaacggcccgttccggcccccgttcgggtccctaaccgttcccgtcccggtttcccccgtcccccgttcccgttcccg

SEQ ID NO: 358892 - DNA, 555 bp, Homo sapiens
  misc_feature: GZ8MTXP01CIR8B.17.33.C11.1.454.CMB.2.raw
  modified_base (412)..(412): a, c, t, g, unknown or other
  misc_feature (412)..(412): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattggatgagagtaagcactacagtccgtctctagaagaacaggctccaccatcacaagaacacctccacaaaccaggtcgtcctacaatgaccaatactggaccctgtggacacagccanatattactgttacacgtcttctagtgggttcggggatttagttacgtccctactttgaccttcgtggggccaggggaaccttcgtcgggtccaccggttcttccggcacgccctcccaccgaacgggtccccaagttccccgg

SEQ ID NO: 358893 - DNA, 515 bp, Homo sapiens
  misc_feature: GZ8MTXP01A7DFS.17.33.C11.1.454.CMB.2.raw
  modified_base (354)..(354): a, c, t, g, unknown or other
  misc_feature (354)..(354): n is a, c, g, or t
  modified_base (422)..(422): a, c, t, g, unknown or other
  misc_feature (422)..(422): n is a, c, g, or t
  modified_base (457)..(457): a, c, t, g, unknown or other
  misc_feature (457)..(457): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgtcagcccccaggaaggccctggagtggcttgcgctcatttattgggatgagagtaagcactacagtccgtctctgaagacaggctccacatcacagaacaccncacaaacagtgtccttacaatgaccaatatcggaccctgtaggacacacgcacatattactgttcacnctctagtggttcggggattattacgtccctatttncgtactgggcagggaacttcgtaggtcacgttcttcgcaccncncacacgccgcgtcg

SEQ ID NO: 358894 - DNA, 572 bp, Homo sapiens
  misc_feature: GZ8MTXP01AYJYS.17.33.C11.1.454.CMB.2.raw
  modified_base (266)..(266): a, c, t, g, unknown or other
  misc_feature (266)..(266): n is a, c, g, or t
  modified_base (312)..(312): a, c, t, g, unknown or other
  misc_feature (312)..(312): n is a, c, g, or t
  modified_base (330)..(330): a, c, t, g, unknown or other
  misc_feature (330)..(330): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggtccagcagaacnggacagcaccaggcactcattatagtaacaaacaacaaacactccncggacccctgccgattcncacggcctccccctcgttggggacaacgctcgccctgacactgtctggtgtgcacgcctggacggacgaggctagtactattactcgtcctacttcttacgttgggggtgtgtcgtgtgctagttcgggacggacggtacaagctcggaaccgttcgttaacgtccacgacccgaacggccgttccgcccccgttcggtcctaaccgttccttccgttcccctaacccttcccgttaacccg

SEQ ID NO: 358895 - DNA, 611 bp, Homo sapiens
  misc_feature: GZ8MTXP01A0NW8.17.33.C11.1.454.CMB.2.raw
  modified_base (570)..(570): a, c, t, g, unknown or other
  misc_feature (570)..(570): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaacggccctggagtggcttgcgctctatttagtgggatgagagtaagcactacagtccgtctctagaagaacaggcctaccaccatccaaccgaaggaaccaccctccgaaacaaacccgagggtcgtaccttaacaaatcgaacccaaatacgtacggacccgtgtacggaaccacgacgacccaacattaacttacgttcgttacaacggtctacgttacgttgggttaccggggtatttacgttacgtcccttactttgaccttacgtcggggccaggggtacttcgtacggtccaccgttcncccgcacgccctccgaccgaccgggcccttaagttccccgg

SEQ ID NO: 358896 - DNA, 533 bp, Homo sapiens
  misc_feature: GZ8MTXP01C2N6K.17.33.C11.1.454.CMB.2.raw
  modified_base (321)..(321): a, c, t, g, unknown or other
  misc_feature (321)..(321): n is a, c, g, or t
  modified_base (525)..(525): a, c, t, g, unknown or other
  misc_feature (525)..(525): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaaggccctggagtggcttgcgctcatttattgggatgagagtaagcactacagtccgtntctgaagaacaggctccaccatcaccaagaacacctcaacaaaccaggtgtcctacaatgaccaatatggaccctgtaggacacagccaacatattactgttacacgtcttctagtgggttcgggagttattagtcccttaatttgacttacgtggggccagggtacttgtggtcacgttcttccgcagccctcaccaggcccngttcccgg

SEQ ID NO: 358897 - DNA, 640 bp, Homo sapiens
  misc_feature: GZ8MTXP01BREWT.17.33.C11.1.454.CMB.2.raw
  modified_base (411)..(411): a, c, t, g, unknown or other
  misc_feature (411)..(411): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaacggccctggacgtggcttgcgctcatttatgggatgagagtaagcactacagtccgtctctagaagaacaggctccaccataccaacccaaaggaaccaaccctccaaacaaaccagggtacgtaccttaacaatacgaccaatanggaccctgagacacagccacatatactgttcacgtcttcctagttgggttccggggtagtttaattaaccggttccccttaaacgtttcgaaccgttacgtcggggggtaccccttaagggggtaaaccttcgttacggggtccttaaccccgggttccttaccccggcaaccgggtccccttacccgaaccccgttaaacgggggcccccttaaggtttccccccggg

SEQ ID NO: 358898 - DNA, 547 bp, Homo sapiens
  misc_feature: GZ8MTXP01ACSX7.17.33.C11.1.454.CMB.2.raw
  modified_base (377)..(377): a, c, t, g, unknown or other
  misc_feature (377)..(377): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
  modified_base (513)..(513): a, c, t, g, unknown or other
  misc_feature (513)..(513): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaagccctggagtggcttgcgctcatttatgggatgagagtaagcactacagtccgtctctagaagaacaggctccaccatcaccaaggaacacctccacaaaccaggtcgtcctanaatgaccaatatggaccctgngacacagccanatatactgttcacgtctctagtgggttcggggatttagttacgtcccttactttgaccttacgtgggggcccaggggaccttgtcggtccaccgttcttcccgnacgccctccaccgaacgggccccaagttccccgg

SEQ ID NO: 358899 - DNA, 567 bp, Homo sapiens
  misc_feature: GZ8MTXP01ENTW4.17.33.C11.1.454.CMB.2.raw
  modified_base (271)..(271): a, c, t, g, unknown or other
  misc_feature (271)..(271): n is a, c, g, or t
  modified_base (296)..(296): a, c, t, g, unknown or other
  misc_feature (296)..(296): n is a, c, g, or t
  modified_base (490)..(490): a, c, t, g, unknown or other
  misc_feature (490)..(490): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccnggacaagcaccaggcactcatttanagtaacaaacaacaaacactcctggacccctgcccgattctcacggcctcccccgtcgttgggggcaaacgctacgccctgacactgtctggtgtgcagcctggaggacgaggctagactatactgcctactcttacgttggggtggtgtctgtgtcgtagttcggcgggacggtaccaagccgtgaaccgttnttaacggtcacgcccgaaggccgttccgccccgtcggtcctaaccttctccgttcccctaacccgttccttaacccg

SEQ ID NO: 358900 - DNA, 551 bp, Homo sapiens
  misc_feature: GZ8MTXP01CTP08.17.33.C11.1.454.CMB.2.raw
  modified_base (226)..(226): a, c, t, g, unknown or other
  misc_feature (226)..(226): n is a, c, g, or t
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (321)..(321): a, c, t, g, unknown or other
  misc_feature (321)..(321): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (426)..(426): a, c, t, g, unknown or other
  misc_feature (426)..(426): n is a, c, g, or t
  modified_base (457)..(457): a, c, t, g, unknown or other
  misc_feature (457)..(457): n is a, c, g, or t
  modified_base (491)..(491): a, c, t, g, unknown or other
  misc_feature (491)..(491): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcacagtgcttactatccaaactggttccagcaagaaaccnggacaagcacccaggcactcatttaanagtaacaaaacaacaaacactccncggaccccctgcccgtattctcacggcctcccccctcgtggggcaaagctacgccctgacactgtcngggtntgcagcctagagggacgaggctagactattacngcctactactacgtttggggtggtgtctgtncgtagttcggacggtaggaccagctgaaccgttnttagtcacgaccgaagcgttcgcccctggacctctcgtcttcccctaaccgttccctccg

SEQ ID NO: 358901 - DNA, 647 bp, Homo sapiens
  misc_feature: GZ8MTXP01CLQ8F.17.33.C11.1.454.CMB.2.raw
  modified_base (221)..(221): a, c, t, g, unknown or other
  misc_feature (221)..(221): n is a, c, g, or t
  modified_base (611)..(611): a, c, t, g, unknown or other
  misc_feature (611)..(611): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctgggtcctacgctggtgaaacccacacagaccctcacgctgacctgcctaccttctctggcttctcactnagaacgagtggaatgggagtgggctggactcgcacgccccgaaggaacgcctggagtgcttgcgctactagtttagtagggataggaagtagtaagacctacgtacgtacgtcccgtctacgtagaaacgaacgacggctaccccaccactaccaaaccgaacgaaccaccctaaccaaactaaacccgtgggtacgtacctaacgaatacgaacctaatacgtacgggtaccctgtacggaacaacgacgacccaatattaacttacgtgttaccaacgttcgtacttacgggttggggttacggggtagtttacttaacggttccccttagtttcgacgtggtcggggacttagggtacttcggtacggtccaccggttcacccggtnccgccctacgacccgacgggtcccaacgtttcccgg

SEQ ID NO: 358902 - DNA, 597 bp, Homo sapiens
  misc_feature: GZ8MTXP01DY9MP.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcacctgtgcttaccaacactggagcagtcaccagtgtcttactactaccaaactggttccagcaagaaacctggaacaagccaacccgaggcactctatttatagtacaaacaaacaaacactcctacggacccctgcccgtattctcacggcctccccctcgttggggacaaacgctacgccctgactacgtcgtcgtggtgtcgcacgcgtaggacgacgagctagtactacttactcgtacctactacttacgtttggggtgtcgtcgtgtgtacgtgttcggacggacggtacaagtctcgtaaccgttacttacgtcgaccgaccgaacgttccgttcccgccccgtcgtacctcgttcctccgttcccctaacccgttccttaacccg

SEQ ID NO: 358903 - DNA, 693 bp, Homo sapiens
  misc_feature: GZ8MTXP01DRNSA.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaggccctggagtggcttgcgctcatttatgggatgagagtaagcactacagtccgtctctgaagaacaggctccaccatcaccaaggaaccaccctccaacaaaaccaggtacggtaccttaacaatcgaaccaaatactacgggaccctggtacgggaacacaacgcccaacacttaactttaactcggtttccaacggtcttaccgttaagttggggtttccgggggaagttttacgtttaacggttccccctttaacgttttcggtaacccgttaccggttaacggggggaccccttagggggtaaacccttcggttacggggttacccttaaccccgggttccttcccccgggaaccctaaccgggtcccccttaccccgaaccccggttaaacgggggcccccccttaacggttttccccccgggg

SEQ ID NO: 358904 - DNA, 628 bp, Homo sapiens
  misc_feature: GZ8MTXP01BAWJ7.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtcctctctagaagaacaggcctccaccatcaaccaagaaccacctccaacaaaccaggtacgtacctaacaatacgaccaatatcggaccctgtaggacacagtccaacatacttaacgtgttccacgtctctagtgggttcggggtatttagtttacgtccccttagtttcgaccgttgtcgggggtcccttaaagggggtaaccttcggtacggggttacccttaacccgggttccgttaccccggcctaaccggcccccttacccgaacccggaaacccgggggtccccttaacgggtttccccccggg

SEQ ID NO: 358905 - DNA, 555 bp, Homo sapiens
  misc_feature: GZ8MTXP01BV4KA.17.33.C11.1.454.CMB.2.raw
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttcccagcagaaaccnggacaagcacccagggcactcatttanagtacaaacaacaaacactcctgacccctgcccgattctcaggcctccccctccgttgggggcaaacgctcgccctgacactgtctggtgtgcagcctgaggacgagggctaggacttatactgcctactcttactttggggtgtgctgtgctagtcggacggtaggacccaagcgtcggaaccgttcttaaagtcacgtcccgaggccgttcgcccccgtcggtcaacgtcctcgttccccaacccgttccttcccg

SEQ ID NO: 358906 - DNA, 585 bp, Homo sapiens
  misc_feature: GZ8MTXP01C2XNK.17.33.C11.1.454.CMB.2.raw
  modified_base (320)..(320): a, c, t, g, unknown or other
  misc_feature (320)..(320): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggactccgcagccccaggaacgcctggagtggcttgcgctcatttatgggatgagagtaagcactacagtcccgtntcgtagaagaacaggctccaccatccaaccaaggaaaccaccctccaaacaaaaccgaggtacgtacctacaaatcgaaccaataatcggaccctgtacggacacgacacacatattactgtttacacgtctctagtgggttcggggatttacttacggttcccttaacgtttgaaccgttcgtaaggggcccgttaaggggtaccttcgttacggtcttacccgttcttccgcacgcctaccaccgacggtcccaagttccccg

SEQ ID NO: 358907 - DNA, 579 bp, Homo sapiens
  misc_feature: GZ8MTXP01B5LUH.17.33.C11.1.454.CMB.2.raw
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccnggacaagcaccaggcactcatttanagtacaaacaacaaacactcctcgacccctgcccgattctcaggcctccccctccgttgggggcaaagctacgccctgacactgtctggtgtgcagcctgaggacgaggctagactatactgcctactctacgtttggggtcgtgctgtcgtcgtagttcggcgggtagggaccaacgtcgtgtaacccgtcttaaagtccgaacgtccccgaacggcccgttcgccccccgttcgggtccctaaccgttccgttccgttcccccgtccccttcccgttccccg

SEQ ID NO: 358908 - DNA, 594 bp, Homo sapiens
  misc_feature: GZ8MTXP01ACL7L.17.33.C11.1.454.CMB.2.raw
  modified_base (586)..(586): a, c, t, g, unknown or other
  misc_feature (586)..(586): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgcagcccccaggaagcctggagtggcttgcgctcatttattgggatgagagtaagcactacagtccgtctctagaagaacaggctcccaccatccaaccaaggaaccaccctccaacaaaacccagggtcggtaccttaacaaatacgaaccctaaagtactcgggaacccctggtacggaacacgagcccaatataattactgttacacggcttacgtagttcgggtttcgggggtatttactttacgtccccttaagttttcgaaccttacggtgggggcccaggggtaccttcgtggtccaccgttcttccgcacgcctccaccgacgggcccngttcccgg

SEQ ID NO: 358909 - DNA, 622 bp, Homo sapiens
  misc_feature: GZ8MTXP01DGB1V.17.33.C11.1.454.CMB.2.raw
  modified_base (231)..(231): a, c, t, g, unknown or other
  misc_feature (231)..(231): n is a, c, g, or t
  modified_base (278)..(278): a, c, t, g, unknown or other
  misc_feature (278)..(278): n is a, c, g, or t
  modified_base (308)..(308): a, c, t, g, unknown or other
  misc_feature (308)..(308): n is a, c, g, or t
  modified_base (561)..(561): a, c, t, g, unknown or other
  misc_feature (561)..(561): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtcgcttaccaacactggancagtcaccagtgcttactataccaaactggtaccagcaacgaaaccnggaacaacgccaccgaggcactcaatttanaacgtaacaaaacaaacaaaccactaccgtacggacccctcgacccgtattcctacgacggtccttccccccgtccggttagggggaccaaacgtcctcgacccctgaaacctcgtcgtcgtggtgtcgacacgtccaggaacgggacgacgggtctacgtaacttacgttaactcgaccttactcgtttacgttgggggtgtcgtctgtgtcttaggtcgggacggacggacagtctcgaacgttacgttancgacgaccaggccttccgccccgtgccctaacttcgtaccttcccaacccgttctaacccg

SEQ ID NO: 358910 - DNA, 745 bp, Homo sapiens
  misc_feature: GZ8MTXP01C42QO.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaagtgggagtgggctggactccgtcacgcccccaggaaacggccctggagtggcttgcgctctatttagtggatgagagtaagcactacagtcccgtctcgtagaagaacaggctcccaccatacaaccaacggaaccaccctcccaaacaaacccgaggttacggtacccttaacaaactacgaaccctaaattacgtacggaccccgtggtacggaaccaacacgacccaactaacttaacttaaccttcggtttaccaacggttcctttacgttaaacggttcgggggttttaaccgggggtaagttttaacgttttaaccggttaccccgtttaacgttttacggaaccgtttacgggttaacgggggacccttaaaggggggtaaaccttccggttaaccggggtcccttaaccccgggtttcccgttacccgggaaccctaaccggtcccccgttaaccccgaacccggttaaacccgggggtcccccgaaccggttttccccccgggg

SEQ ID NO: 358911 - DNA, 552 bp, Homo sapiens
  misc_feature: GZ8MTXP01DCCXH.17.33.C11.1.454.CMB.2.raw
  modified_base (270)..(270): a, c, t, g, unknown or other
  misc_feature (270)..(270): n is a, c, g, or t
  modified_base (420)..(420): a, c, t, g, unknown or other
  misc_feature (420)..(420): n is a, c, g, or t
  modified_base (526)..(526): a, c, t, g, unknown or other
  misc_feature (526)..(526): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccnggacaagcaccagggcactcatttatagtacaaacaacaaacactcctggacccctgccgattctcagctccccctccgttggggcaaagctacgccctgacactgtctggtgtcgcacgccgtgaggacgaggtctaggtactattacncgtacctactcttacttggggtgtgtctgtgtcttagtcggacggacgggtaccaaggtctggtaaccgtcttaaagtcacgcccaaggccgttcgcccctcgtcncgtctcgttccctccttccttaaccg

SEQ ID NO: 358912 - DNA, 522 bp, Homo sapiens
  misc_feature: GZ8MTXP01C5P4M.17.33.C11.1.454.CMB.2.raw
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (294)..(295): a, c, t, g, unknown or other
  misc_feature (294)..(295): n is a, c, g, or t
  modified_base (302)..(303): a, c, t, g, unknown or other
  misc_feature (302)..(303): n is a, c, g, or t
  modified_base (311)..(312): a, c, t, g, unknown or other
  misc_feature (311)..(312): n is a, c, g, or t
  modified_base (318)..(318): a, c, t, g, unknown or other
  misc_feature (318)..(318): n is a, c, g, or t
  modified_base (322)..(322): a, c, t, g, unknown or other
  misc_feature (322)..(322): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
  modified_base (500)..(500): a, c, t, g, unknown or other
  misc_feature (500)..(500): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagaccctcacgctgacctgccaccttctctggcttctcactcagaacgagtggaatggggagtcgggctggacacggcgacgcccaaggaacgcctgagtgctgngctntatatgnngagagannacacatcnnagaganagcnccacanacacacaacacncacaacgacgtcgtactacanacacanatacgacgngacgacacacacactatactactctcgtctcgtcgtagtaggtcggtagttacgttacgtaccttacgtacgtacgtcgtcggcgacgtacgttcgtcgtcgttccgttcgttccgcaccgccnccaccgaccgtccgttcgtccg

SEQ ID NO: 358913 - DNA, 555 bp, Homo sapiens
  misc_feature: GZ8MTXP01CV3D5.17.33.C11.1.454.CMB.2.raw
  modified_base (269)..(269): a, c, t, g, unknown or other
  misc_feature (269)..(269): n is a, c, g, or t
  modified_base (296)..(296): a, c, t, g, unknown or other
  misc_feature (296)..(296): n is a, c, g, or t
  modified_base (386)..(386): a, c, t, g, unknown or other
  misc_feature (386)..(386): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggttccagcagaaaccnggacaagcacccagggcactcatttanagtacaaacaacaaacactcctggacccctgcccgattctcaggcctccccctccgttgggggcaaagctcgccctgacactgtctggtntgcagcctggaggacgaggcctgacctattactgcctactcttacgtttggggtggtgcgtgtgctagttcggacggtaggtaccaagctgaaccgtcttaaggtcacgacccgaaggccttcgcccctggtcctaacttcctcgttcccctaacccttccttaacccg

SEQ ID NO: 358914 - DNA, 569 bp, Homo sapiens
  misc_feature: GZ8MTXP01DRRM7.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaacggccctggagtggcttgcgctcatttagtggatgagagtaagcactacagtccgtctctagaagaacaggctaccaccatacaaccaaggaaccacctccaacaaaccgaggtcgtacctacaatacgaaccaatatcggaccctgtacggacacgagccaacattacttactgttcacgtcttctagtgggttcgggattacttacgtcccttagttgacctagtcggggccaggggtaacttcgtcggtcaccgttcttcccgcacgccctccgaccgaacgggtccccaagttccccgg

SEQ ID NO: 358915 - DNA, 589 bp, Homo sapiens
  misc_feature: GZ8MTXP01CYYS3.17.33.C11.1.454.CMB.2.raw
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcacctttctctggcttctcactcagaacgagtggaatggggagtgggctggactccgtcacgcccccgaggaacggccctggagtggcttgcgcgtctatttattggatgagagtaagcactacncgtccgtcnctagaagacagctccaaccactcaaccaaggaaccaaccctccaaacaaaccgagggtacggtaccttaacaaactcgaaccctaaatacgttacggaccctgtacggaacaccgacacccaacattaattaactgttacacgtcttctagtgggttacggtagttattacgtcctacgtttcgacttcgtcgggcgagggtacttcgtcgcttaccgttcttccgcacgccctaccgaccgacggtcccaagtccccg

SEQ ID NO: 358916 - DNA, 568 bp, Homo sapiens
  misc_feature: GZ8MTXP01CU00J.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaacggccctggagtggcttgcgctcatttatgggatgagagtaagcactacagtccgtctctagaagaacagctaccacatcacaagaaccacctccaacaaacaggtcgtactacaatcgacaatatcgaccctgtacgacacagccaacatattactgttcacgtctctagtgggttacgggtattagttacgtcccttagtttgacgttacggtcgggggaccaggggtaacttcgtcgggtccaccggttcttcccggcaccgtcctacccgaccgttaacgggccccaagttccccggg

SEQ ID NO: 358917 - DNA, 566 bp, Homo sapiens
  misc_feature: GZ8MTXP01ENKNN.17.33.C11.1.454.CMB.2.raw
  modified_base (381)..(381): a, c, t, g, unknown or other
  misc_feature (381)..(381): n is a, c, g, or t
  modified_base (394)..(394): a, c, t, g, unknown or other
  misc_feature (394)..(394): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaaggccctggagtggcttgcgctctatttagttggatgagagtaagcactacagtccgtctctgaagacagctccaccatcacaacgaccacctccacaaaccaggtcgtaccttanaatgaaccaatanggaccctgtggaacacagcaacatattactgttcacgtctctagtgggttcgggtatttattacgtccttatttcgacgtcgtgggggcccaggggtaaccttcgtacgggtccaccgttccttccgccgtacgccctcccgaccttacggggaaccccttcggtttccccg

SEQ ID NO: 358918 - DNA, 602 bp, Homo sapiens
  misc_feature: GZ8MTXP01D4KJH.17.33.C11.1.454.CMB.2.raw
  modified_base (272)..(272): a, c, t, g, unknown or other
  misc_feature (272)..(272): n is a, c, g, or t
  modified_base (298)..(298): a, c, t, g, unknown or other
  misc_feature (298)..(298): n is a, c, g, or t
  modified_base (428)..(428): a, c, t, g, unknown or other
  misc_feature (428)..(428): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtcaccagtgcttactatccaaactggttccagcaagaaaccnggacaagcacccaggcactcatttanagtaacaaacaacaaacactcctacggacccctgcccgtattcctcacggtcctccccccgtccgttggggacaaagctcgccctgacactgtctggtgtgcagcctgaggacgagctagacttattacngtcctactcttacgtttgggggtgtgtctgtgtcgtacgttcgggacggtacgggacccaaagtcctaggtaaccgttcttaaacgtcgacgacccgtaaggttcccgttccggttccccccgtcgggtcctaacccgttccgtccgttccccctaaccccttcccttaacccg

SEQ ID NO: 358919 - DNA, 645 bp, Homo sapiens
  misc_feature: GZ8MTXP01CQI34.17.33.C11.1.454.CMB.2.raw
  modified_base (604)..(604): a, c, t, g, unknown or other
  misc_feature (604)..(604): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgctaccttctctggcttctcactcagaacgagtggaatgggagtgggctggatccgtcacgccccgaggaacggccctggagtggcttgcgctctatttagtggatgagagtaagcactacagtccgtctctagaagaacaggcctacccaccataccaaccgaaacggaacccaccctaacccaaaccaaaccgacgggttacgtacccttaacaaactacgaaccctaaagtacgtacggacccttggacggaacaacacgacccataattaacttacgttcttcgaacgttcttcgttaggttgggtttacggggtatttacgtttaccggttcccttagtttacgaaccgttcggttcggggaaccttaggggtaccttcgtacgggtcccaccggttcacccgnacccgccctacccgaccgaaccgggtcccaacgtttccccg

SEQ ID NO: 358920 - DNA, 563 bp, Homo sapiens
  misc_feature: GZ8MTXP01COSI3.17.33.C11.1.454.CMB.2.raw
  modified_base (226)..(226): a, c, t, g, unknown or other
  misc_feature (226)..(226): n is a, c, g, or t
  modified_base (267)..(267): a, c, t, g, unknown or other
  misc_feature (267)..(267): n is a, c, g, or t
  modified_base (292)..(292): a, c, t, g, unknown or other
  misc_feature (292)..(292): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggtccagcagaacnggacaagcaccaggcactcatttanagtacaaacaacaaacactctcggacccctgcccgattctcaggcctacccccgtccgttggggcaaagctacgcctgacactgtctggtgtgcacgccgtaggaggacgaggctagactatactgcctactctacgttggggtcgtgtctgtgcgtacgttcggacggaggaccgaagtcctggaaccgtcgttaagtccgagacccgaaggccgttccgcccccgtcggtcctaaccgttccgtcccgttcccgtcccgttcccttccg

SEQ ID NO: 358921 - DNA, 587 bp, Homo sapiens
  misc_feature: GZ8MTXP01DKMPJ.17.33.C11.1.454.CMB.2.raw
  modified_base (175)..(175): a, c, t, g, unknown or other
  misc_feature (175)..(175): n is a, c, g, or t
  modified_base (243)..(243): a, c, t, g, unknown or other
  misc_feature (243)..(243): n is a, c, g, or t
  modified_base (288)..(288): a, c, t, g, unknown or other
  misc_feature (288)..(288): n is a, c, g, or t
  modified_base (381)..(381): a, c, t, g, unknown or other
  misc_feature (381)..(381): n is a, c, g, or t
  modified_base (390)..(390): a, c, t, g, unknown or other
  misc_feature (390)..(390): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggacgccctnactgactgtgtcccaggaggacagtcactctcacctgtgcttaccaaacactggagcagtcaccagtncttacatacaaactggtcagcagaaactgacaagcaccaggcacncattatagaacaaacaaacaaacactccacggaccctgccgatctcacggcctcctcgtggggacaaaagctcgcctgaccactcgtctggtntcgcacgcngagacgaggctgactatactgcttactcgttagtttggtggtgcgtgtcgtacgttacgttccgggacgggaacggggaaccaaaggtccgtaggttaccccgttagttaaacgtaccgtacgttacccgaaacggttccgttccgcccccccgttcggtccctaccgttcccttcccgtttcccccgtaacccccg

SEQ ID NO: 358922 - DNA, 583 bp, Homo sapiens
  misc_feature: GZ8MTXP01BQZHW.17.33.C11.1.454.CMB.2.raw
  modified_base (284)..(284): a, c, t, g, unknown or other
  misc_feature (284)..(284): n is a, c, g, or t
  modified_base (310)..(310): a, c, t, g, unknown or other
  misc_feature (310)..(310): n is a, c, g, or t
  modified_base (353)..(353): a, c, t, g, unknown or other
  misc_feature (353)..(353): n is a, c, g, or t
  modified_base (549)..(549): a, c, t, g, unknown or other
  misc_feature (549)..(549): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtcgggctgggactacggcgacgacccaggaagcctggagtgctgcgntcattatggatgagagtaagcactanacgtcgtctcagagacgacgcaccacacacacacgaaccaccncaacaacgacgtacgtactacacacactactagtacgtacgtacgacgacgacacgacactactactacttcgttacgtacgtcgtcgtacggttacggttacggttagttacgtttacgttaccgttacgtttacgtacgtacggtaacgggtacggttacggtacgttcgtcgtcgttccgttccgttccgtcnccgccgtaccgaccgaccggtcccgttccgtccg

SEQ ID NO: 358923 - DNA, 592 bp, Homo sapiens
  misc_feature: GZ8MTXP01BQKT8.17.33.C11.1.454.CMB.2.raw
  modified_base (185)..(185): a, c, t, g, unknown or other
  misc_feature (185)..(185): n is a, c, g, or t
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
  modified_base (349)..(349): a, c, t, g, unknown or other
  misc_feature (349)..(349): n is a, c, g, or t
  modified_base (374)..(374): a, c, t, g, unknown or other
  misc_feature (374)..(374): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctnatgctgacctgcaccttctctggcttctcactcagaacgagtggaatggggagtgggctggactccgcagccccaggaagccnggagnggctgcgctcattatggatgagagtaagcactacagtccgtctctagaagacaggcctcacatcaacaaacgaccncctccaacaaacaggtcgtacttanactagaccaatagtggaccctgtacggacacagccaactataactttaaccttcgttctacgtcttacgttagttcgggttacggggttatttaacgttaccgttacctttacttacgtacgtaacggtcgggacgtaacgggttacgttcgtcggttccgttacccgttccgtcccgccgaaccgcccgtacccgacccgtaaccggcccgtaaccg

SEQ ID NO: 358924 - DNA, 803 bp, Homo sapiens
  misc_feature: GZ8MTXP01DW0B5.17.33.C11.1.454.CMB.2.raw
  modified_base (281)..(281): a, c, t, g, unknown or other
  misc_feature (281)..(281): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggaggacagtcactctcacctgtgcttccaacacgtggagcagtcaccagtgacttactactaccaaacgtcggttccagacaacgaaaccgnggaacaacgcaacccgagggcactactaatttaataacgtaaacaaaacaaacaaaaccactaccctacggaccccctcgaccccgtaattcctacgacggtcctccccccgttccggttagggggacaaacggccttacgcccctgacctacgtcgtcgtgggttgcgccgagcccgtaggaacgggaccggaggtacgtacggtaactttaacgttaaccgtcgtacccgttaacctttcgtttaaccggtttttcgggggttcgggtttggttacccgtttgggttcgttaccgttaacggtttccgggggaaccgggggtaaccggggaacccgtaaaacggtccgttaacgggtaacccggttttaaccgttttaaaggtaccccgaaaccggtccccggaacgggttccccgttcccccgggttacccccccggtttcccgggttaacccgttaacccgtttccccttccccggtttaacccccccgttaacccccgtttccccgtttaacccccg

SEQ ID NO: 358925 - DNA, 679 bp, Homo sapiens
  misc_feature: GZ8MTXP01D1U30.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtgggagtgggctggactccgtcacgccccgaggaacggccctggagtggcttgcgctctatttagtggatgagagtaagcaactacgacgtccgtctctagaagaacgaggctacccaccataccaaccaaacggaacccaaccctcccaaacaaacccgtaggtacgtaccttaacaaactacgaaccctaaattacgtacgggtaccctggtacggaaaccacgacgacccaatacttactttaacgttcgttaccaacggtccttacgttaggttggggttaccgggtaagtttacgtttaccggtcccctttagtttacgaaccgttacggttcgggggacttaacggggtaaccttcggtcgggtcccttacccgttcgttacccgccgtaccgtccccgtacccgaccggaaaccgggtccccttaacggtttcccccggg

SEQ ID NO: 358926 - DNA, 602 bp, Homo sapiens
  misc_feature: GZ8MTXP01CE763.17.33.C11.1.454.CMB.2.raw
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctgggactacggtcacgaccccgaggaacgccctggagtggcttgcgctcatttattggatgagagtaagcactacagtccgtctctagaagaacagctaccaccatccaaccaaggaaccaccctccacaaaccgaggtcgtaccttacaatcgaaccaattancggaccctgacggacacgancccaatatacgtactctcgacgtcgtacgttaggttggttacggtatttaacgttaccgttaccttagtttcgacgttcggtcggggtacgttaacgggtaccttcggtacggtacccttaccgttccgaccgctaccgtcccgtacccgacccgaccggtaacccgttccgtccg

SEQ ID NO: 358927 - DNA, 638 bp, Homo sapiens
  misc_feature: GZ8MTXP01CHZFU.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgcagcccccaggaaacggccctggagtggcttgcgctcatttatgggatgagagtaagcactacagtccgtctctagaagaacaggcctaccaccatacaaccaaggaaccaccctccaacaaaccgaggtcgtaccttaacaaatagaacccaatacgtacggacccctaggtacggaaccaacgagacccaactaattacttaactcgtttaccacggtccttcttaacgttggggtttacggggtagttttactttaaccggttcccctttactttcggtaaccgttaacggtcgggggacccgttagggggtaaaccttccgtacgggtccacccggttcttccgcgacgccctaccgacccaacggggtccccaagttccccgg

SEQ ID NO: 358928 - DNA, 608 bp, Homo sapiens
  misc_feature: GZ8MTXP01BRUIQ.17.33.C11.1.454.CMB.2.raw
  modified_base (282)..(282): a, c, t, g, unknown or other
  misc_feature (282)..(282): n is a, c, g, or t
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtcccagggaggacagtcactctcacctgtcgcttaccaacactggagcagtcacagtcgtacttactatacctaaactcggttaccagacaacgaaaccnggaacaagccaccaggcactnatttanagtaacaaacaacaaacactctacggaccctgccgatctcagcctcccctcgtggggacaaacgctacgccctcgactactgtctggtgtgacacgccgtaggacggacgaaggctacggtacttacttaactcgaccttacttagtttaccgtttgggggttggtgttccgtgtacgtcgtaacggttcggacggggtaacggaaccgtaacgtcgtacggtaaccgtatttaacgcacgtaccgaacgcgttccgccccgtcgtctaactccgtccttcccgtcccttccgtaaccg

SEQ ID NO: 358929 - DNA, 623 bp, Homo sapiens
  misc_feature: GZ8MTXP01EUPYH.17.33.C11.1.454.CMB.2.raw
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (280)..(280): a, c, t, g, unknown or other
  misc_feature (280)..(280): n is a, c, g, or t
  modified_base (286)..(287): a, c, t, g, unknown or other
  misc_feature (286)..(287): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggacntccgnacgcccaggaacgcngngngctgcncntatgtnntaggtagagtagagtacgtacgactacgtacgtacgtacgtactacgacgaacgacgacgaccaccaaaccaaccgaaccaaaccgaacgaaccctaccaccgaacgtaacgtacgtacgtactaactaactacgaacgtaacgtacgtacgacacgacgacaacacactacgtacttactacgttacgtacgtacgttcgttacggttacggttacgggttacggttacgttacgttaccgttaaccgttacgttacggtacgttacgggtacggtacggacggttccgttccgtcgtccgtccgtccgccgaccgtaacccgaaccgtaacccg

SEQ ID NO: 358930 - DNA, 523 bp, Homo sapiens
  misc_feature: GZ8MTXP01ACJMO.17.33.C11.1.454.CMB.2.raw
  modified_base (333)..(333): a, c, t, g, unknown or other
  misc_feature (333)..(333): n is a, c, g, or t
  modified_base (378)..(378): a, c, t, g, unknown or other
  misc_feature (378)..(378): n is a, c, g, or t
  modified_base (388)..(388): a, c, t, g, unknown or other
  misc_feature (388)..(388): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
  modified_base (465)..(465): a, c, t, g, unknown or other
  misc_feature (465)..(465): n is a, c, g, or t
  modified_base (494)..(494): a, c, t, g, unknown or other
  misc_feature (494)..(494): n is a, c, g, or t
  modified_base (499)..(499): a, c, t, g, unknown or other
  misc_feature (499)..(499): n is a, c, g, or t
  modified_base (517)..(517): a, c, t, g, unknown or other
  misc_feature (517)..(517): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgcacgccccaggaaggccctggagtggcttgcgctcatttattgggatgagagtaagcactacgagtccgtctctgaagaacnggctcaccatcaccaagaaccacctcacaaaccaggtgtccttanatgaccaatntggacctgngacacngccanatatactgttcacgtntctagtggttcggggattattagtccctatttcgcttacgngggccagggacttgtcggtcaccgttccnccgcncgcctcacgaccggtccngtcccg

SEQ ID NO: 358931 - DNA, 612 bp, Homo sapiens
  misc_feature: GZ8MTXP01EO8FZ.17.33.C11.1.454.CMB.2.raw
  modified_base (300)..(300): a, c, t, g, unknown or other
  misc_feature (300)..(300): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacacgtggagcagtcaccagtgcttactataccaaactgttccagcaagaaaccaggacaagccaccaggcactcatttanagtaacaaacaacaaacactcctacggacccctcgacccgtattcctacaacggcctccccccgtccggttacgggggacaaacgtctcgccctgactactgtcgtggtgtgcgacgccgtaggacggacgaggctagtacttattaacgtcgtacctacttcttacgtttggggtgtgtctgtgtctagttcggacgggtacggaccgagcgtcggtaaccgtacgttacgtcgacgaccgaacggttccgttcccgccccgttcggtcctccgttcctccgttacccctaaccccttcccgtttaacccg

SEQ ID NO: 358932 - DNA, 557 bp, Homo sapiens
  misc_feature: GZ8MTXP01DHBV8.17.33.C11.1.454.CMB.2.raw
  modified_base (324)..(324): a, c, t, g, unknown or other
  misc_feature (324)..(324): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctgggatccgtcagccccaggaaacggccctggagtggcttgcgctcatttattggatgagagtaagcactacagtccgtcncgtagaagaacaggctccaccatccaaccaacggaccacctccaacaaaccaggtcgtccttaacaatgaccaatatggaccctgtaggacacagaccacatatactgttcacgtctctagtgggttcggggtatttattacgtccctatttgacttagtggggccttaggggacttcgtgggtcaccgttcttacccgcacgcctaccaccgaacgggtcccaagttcccgg

SEQ ID NO: 358933 - DNA, 545 bp, Homo sapiens
  misc_feature: GZ8MTXP01A7105.17.33.C11.1.454.CMB.2.raw
  modified_base (268)..(268): a, c, t, g, unknown or other
  misc_feature (268)..(268): n is a, c, g, or t
  modified_base (293)..(293): a, c, t, g, unknown or other
  misc_feature (293)..(293): n is a, c, g, or t
  modified_base (442)..(442): a, c, t, g, unknown or other
  misc_feature (442)..(442): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttacatccaaactggttccagcagaaaccnggacaagcaccaggcactcatttanagtaacaaacaacaaacactcctcggacccctgcccgattctcagcctccccctccgtggggcaaagctcgccctgacactgtctggtgtgcagcctggaggacgaggctagactattactgctactctacgttggggtgtgcgtgtgngtacgttcggcggaggaccaagctgaaccgtcgttaagtcacgcccgaacggccgttcgccccgtcggtcctaacctcgtccgttccccgcccttccgtcccg

SEQ ID NO: 358934 - DNA, 555 bp, Homo sapiens
  misc_feature: GZ8MTXP01B9TQI.17.33.C11.1.454.CMB.2.raw
  modified_base (417)..(417): a, c, t, g, unknown or other
  misc_feature (417)..(417): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaggccctggagtggcttgcgctcatttatgggatgagagtaagcactacagtccgtctctgaagaacaggctccaccatcaaccaagaaccacctccaacaaaccaggtcgtaccttacaatcgaccaatatcggaccctgtggacacagccanatattactgttcacgtctctagttgggttcggggtattagttacgtccctaatttcgacttacgtggggccaggggacttcgtgggtcacccgttcttacccgctacgccctccaccgacgggtccccaagttcccgg

SEQ ID NO: 358935 - DNA, 627 bp, Homo sapiens
  misc_feature: GZ8MTXP01CBD9R.17.33.C11.1.454.CMB.2.raw
  modified_base (225)..(225): a, c, t, g, unknown or other
  misc_feature (225)..(225): n is a, c, g, or t
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggancagtcaccagtgcttactatccaaactggttaccagcagaaacnggacaagcaccaggcactctatttanagtacaaacaacaaacnctacctcggacccctgcccgattctcacggcctccccctccgttggggactaaacgctcgccctgactacgtgtcgtggtgtgcacgccgtggaggacgaggctaggtactattactgtaccttactcttacgtttggggtggtgtctgtgctacggtcgggtacggacgggtaacccaagtccgtacggtaacccgttacgttaacggtaccgacgaccccgtaacggttcccgttcccgttccccccgttcgggtacccctaaccgttcccgttcccggttacccccctaaccccgttcccctttaaccccgg

SEQ ID NO: 358936 - DNA, 584 bp, Homo sapiens
  misc_feature: GZ8MTXP01ET4M4.17.33.C11.1.454.CMB.2.raw
  modified_base (321)..(321): a, c, t, g, unknown or other
  misc_feature (321)..(321): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (566)..(566): a, c, t, g, unknown or other
  misc_feature (566)..(566): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccggcacgccccaggaagcctggagtggcttgcgctctatttagtgggatgagagtaagcactacagtccgtntctagaagacaggctaccaccgataccaacccaaacggaacccaaccctaaccaaaccaaaacccgtagggtacggtacctttaacaaattacgaaccaaagtactacgggaacccttgaggaacacacgaccaactatattacgtcttacacgtcttataggtggttcggggtattattacgtccttatttgactacgtgggtccagggtacttcgtaggtcttaccgttcttaccgcncnccnccaccgacgccgcgtccg

SEQ ID NO: 358937 - DNA, 632 bp, Homo sapiens
  misc_feature: GZ8MTXP01D4HXC.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcacgccccgaggaaggccctggagtggcttgcgctctatttatgggatgagagtaagcactacagtcccgtctctagaagaacgagctaccaccatacaaccaacggaaaccaccctaaccaaccaaaccgaggtacgtaccttaacaatacgaaccctaaagtactacgggaccctaggtacggaacacagcccaactactaagttactcggtttacaacggtccttaccgttagttcggggttaccggggtagtttacgtttacgtccccttaagtttcgaacttacgggtcggggaccttacggggtaaccttcggtacgtccgaccggttcttcccgcacggccctaccgaccgacgggcccttaacgttccccgg

SEQ ID NO: 358938 - DNA, 571 bp, Homo sapiens
  misc_feature: GZ8MTXP01CYEFM.17.33.C11.1.454.CMB.2.raw
  modified_base (225)..(225): a, c, t, g, unknown or other
  misc_feature (225)..(225): n is a, c, g, or t
  modified_base (269)..(269): a, c, t, g, unknown or other
  misc_feature (269)..(269): n is a, c, g, or t
  modified_base (537)..(537): a, c, t, g, unknown or other
  misc_feature (537)..(537): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggancagtcaccagtgcttactatccaaactggttccagcagaaaccnggacaagcacccagggcactcatttatatacaaacaacaaacactcctcggacccctcgcccgtattctcacggcctcccccctccgttgggggcaaacgctacgccctgacactgtctggtgtgcagctggaggacgaggctgacttattactgtcctactcttacgtttgggggtgtgtcgtgtgtcgtagttcggcgggacggaccgaaggctcggtaaccgtacttaagcttacgccgaagttccgttcgcccccgtcggtccnccgttccgtcgttccccgtccccgttccttcccg

SEQ ID NO: 358939 - DNA, 592 bp, Homo sapiens
  misc_feature: GZ8MTXP01DE2QO.17.33.C11.1.454.CMB.2.raw
  modified_base (388)..(388): a, c, t, g, unknown or other
  misc_feature (388)..(388): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccgtcacgccccaggaacgccctggagtggcttgcgctctatttattggatgagagtaagcactacagtccgtctctagaagaacaggctaccaccatcaaccaagaaccacctccaacaaaccaggtacgtaccttaanaatcgaaccaatactacggaccctggtacggaacacagacccaatatattactgttcaacgtcttactagttgggttcgggtatttagttaacgtcccttagtttcgacgttcggtaacgggggtccaaggggtaccttcgtacgggtccacccgttcttacccgcacgccctaccgaccgttacgggtccccaagttccccgg

SEQ ID NO: 358940 - DNA, 593 bp, Homo sapiens
  misc_feature: GZ8MTXP01AM62Q.17.33.C11.1.454.CMB.2.raw
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
  modified_base (424)..(424): a, c, t, g, unknown or other
  misc_feature (424)..(424): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccnggacaagcacccaggcactcatttanagtaacaaacaacaaacactcctggacccctgcccgattctcacggcctccccctccgtggggacaaacgctacgccctgacactgtcgtggtgtgcagccgtgacggacgaggctagtactattacngcctactcttacgtttggggtggtgtctggtcgtcgttagttcgggaccggtagggacccaaggtctcggaaccgtcgttaaagtccacggccctaaggggccttcccggcccccgttcgggtccctaaccgttcctacccgttcccctaaccccgttccttaaccccg

SEQ ID NO: 358941 - DNA, 548 bp, Homo sapiens
  misc_feature: GZ8MTXP01BIAF8.17.33.C11.1.454.CMB.2.raw
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (286)..(288): a, c, t, g, unknown or other
  misc_feature (286)..(288): n is a, c, g, or t
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
  modified_base (369)..(369): a, c, t, g, unknown or other
  misc_feature (369)..(369): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagcggggctgggactacggcgagacccctagggaagcccgngngngntgnnntatatgagngagaganacacacncgtctcnanaganagcnccacanacacacgaacacncacaacgacgtacgtactacananacatanacgacgtcgacgacacacacactatatactcgtacgtctcgtacgtagtacggttacggtagttacgttacgttaccttacttacgtacgtcggtcggtacggacggtacgttcgtacgtcgttccgttccgttccgcgacgtccgaccgaccgaccgtccgttccgtccg

SEQ ID NO: 358942 - DNA, 536 bp, Homo sapiens
  misc_feature: GZ8MTXP01BTN8O.17.33.C11.1.454.CMB.2.raw
  modified_base (306)..(306): a, c, t, g, unknown or other
  misc_feature (306)..(306): n is a, c, g, or t
  modified_base (368)..(368): a, c, t, g, unknown or other
  misc_feature (368)..(368): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttatggatgagagtaancactacagtccgtctctagaagaacaggctccaccatcaccaaggaaccacctcacaaaccnggtcgtccttacatcgaccaatatcggaccctggtgacacagccacatattactgttcacgtctctagttggttcgggatttattacgtcccttatttgactcgtggggccagggtacttcgtggtcaccgttcttccgcagccctccacgacgggtcccaagtcccg

SEQ ID NO: 358943 - DNA, 535 bp, Homo sapiens
  misc_feature: GZ8MTXP01DN4I4.17.33.C11.1.454.CMB.2.raw
  modified_base (477)..(477): a, c, t, g, unknown or other
  misc_feature (477)..(477): n is a, c, g, or t
  modified_base (527)..(527): a, c, t, g, unknown or other
  misc_feature (527)..(527): n is a, c, g, or t
tcagcgtagactagcacgaccggtgctcgatttagagtgagctcgttgggcttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtaacaaacaaacaaacactcctggacccctgcccgattctcacggcctccctcttgggggcaaagctgccctgacactgtctggtgtgcagcctgaaggcgaggctgactatactgctactctacgtttggtggtgcttgtgtctagttcggcggtagggacccaagctgaccgttntaagttcgacgtcccaaggcttcgcccctcggtccactcttcgttccccncccttccc

SEQ ID NO: 358944 - DNA, 755 bp, Homo sapiens
  misc_feature: GZ8MTXP01AILEW.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgtcacgccccgaggaaacggcccgtggagtggcttgcgctctatttagttggatgagagtaagcactacacgtccgtctctagaacgaacaggcctaccaccataccaacccgaaacggaacccaaccctccaaaccgaaaccgacgggttacggttaccttaacaaacttacgaaccctaaagtacgtacggaccccgttaggtacggaaccaaccgacgacccaaactaacttaactttaccgttaggttaccctaaccggtccgtttacgttacgggttacgggggtttaccgggggttaacgttttaaccgtttaccggtttaccccgttaacgttttacggtaacccgttaaccgggttcgggggaacccgttaacgggggtaaacccttccggttacgggttaccccttacccgggtttcccttccccgggtaaccacccggtccccgtaccccgaaccccgggttaacggggtcccccgttaacgtttccccccgggg

SEQ ID NO: 358945 - DNA, 537 bp, Homo sapiens
  misc_feature: GZ8MTXP01AP17G.17.33.C11.1.454.CMB.2.raw
  modified_base (373)..(373): a, c, t, g, unknown or other
  misc_feature (373)..(373): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcatacagtccgtctctgaagaacaggctccaccatcaccaagaacacctcacaaacagtgtctanatcgacatatggaccctgtagacacagccacatacttactgttcacgtctctattgggtcggggtattattacgttcccttattgtacgtacgtggggtccagggacttcgtaggtcaccggttcttccgcacgccctacacccgagggccccaagttccccgg

SEQ ID NO: 358946 - DNA, 759 bp, Homo sapiens
  misc_feature: GZ8MTXP01DAHWS.17.33.C11.1.454.CMB.2.raw
  modified_base (224)..(224): a, c, t, g, unknown or other
  misc_feature (224)..(224): n is a, c, g, or t
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
tcagcgtagactagcacgaccggtgctcgatttagagtgagctcgttgggtttgggggcgccaggggtcccttcaatatcagcaccatggcctggactcctctctttctgttcctctcacttgctgcccagggtccaattctcagactgtggtgactcaggagccctcactgactgtcgtccccaggaggacagtcactctcacctgtgcttccaacactggancagtcaccagtgcttactatccaaactggtccagcagaacnggacagcaccgagggcacgtctatttanagtaacaaacaacaacactccgtcggacccctgacccgtattcctacacggcctccccccgtccggttacgggggaccaaacggcctaacgcccttggacctacgtgtaccgtgggtcgtcgcctaacgtccgtaggtaacggggtaccggtaggtaccgtacggtaacgtttaactttaaacccgtcggtaccccgtttaaccttacgtttaacccggtttttggggggttcggggtttacggtacccgtttgggttacggtacccgtttaagggttttccgggggaaccggggttaaacgggtaccccgtaaaggtcccgtttaacgggtaaccccgtttacgtttaaacggtaccgttaccggtaaccccgaacgggttccccgttccggttacccccccgtgggttaccctaacccgtttccgtccccgtttacccctaaccccgtttccctttaaccccgg

SEQ ID NO: 358947 - DNA, 687 bp, Homo sapiens
  misc_feature: GZ8MTXP01A9662.17.33.C11.1.454.CMB.2.raw
  modified_base (218)..(218): a, c, t, g, unknown or other
  misc_feature (218)..(218): n is a, c, g, or t
  modified_base (296)..(296): a, c, t, g, unknown or other
  misc_feature (296)..(296): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcctaccttctctggcttcncactcagaacgagtaggaatggggagtgggctggactccggtcacgccccgaggaacgcctggagtggcttgacgctntattagtgggatggagagtaagcacgttacacgtcccgttctacgaagaaacgaacgacgacctaccaacctacaccgaaaccgaacgaaaccctaaccctaaccgaaacgaaaccgtacggtacgtaacctaacaactacgaactaagtacgtacgaccgtagtacgaaccacgactaccaataacgttaacttacttcgtacggtacgtacgttacgttacgggttacgggttacggttactttacgttaccgttaccgttaagttacggtaacgttacgggtaacgggtacgttacgggttaccttcgggtaccgtacccgttaccgttccgccgtaaccgaccgtaacccgtacccgacccggttaccggtaaccgttccgttcccg

SEQ ID NO: 358948 - DNA, 581 bp, Homo sapiens
  misc_feature: GZ8MTXP01EA7B8.17.33.C11.1.454.CMB.2.raw
  modified_base (226)..(226): a, c, t, g, unknown or other
  misc_feature (226)..(226): n is a, c, g, or t
  modified_base (268)..(268): a, c, t, g, unknown or other
  misc_feature (268)..(268): n is a, c, g, or t
  modified_base (431)..(431): a, c, t, g, unknown or other
  misc_feature (431)..(431): n is a, c, g, or t
  modified_base (455)..(455): a, c, t, g, unknown or other
  misc_feature (455)..(455): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttacatccaaactggtccagcagaaaccnggacaagcacccaggcactcatttatagtaacaaacaaacaaaacacctacctacggaccccctcgcccgtattcctcacggcctccccctccgttgggggacaaacgctacgccctgacactgtctggtgtgcagccgtggaggacgagctgactagttacngcctactcttacttggggtgtgtntgtgcctagttcggacggtacggggaccaggcctgtaacccgtcgttaagtccgagaccccgaaggcccgttccgcccccgtcgtactccgttctccgttacccctaacccgttcccgttaacccg

SEQ ID NO: 358949 - DNA, 680 bp, Homo sapiens
  misc_feature: GZ8MTXP01DSYIC.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccgtcacgcccccaggaacggcctggagtggcttgcgctctatttagtggatgagagtaagcactacagtccgtctctagaacgaacgaggcctaccaccataccaacccgaaacggaacccaaccctaacccgaaaccaaaacccgtacgggttacgtacccttaacaaactacgaaaccctaaattacgtacgggaacccttaggtacggaaaccacgaacgacccaaactaattaactttaacttcgtttaccgaacgttcttacgttaaggtttgggggttaccgggtaagtttaacgtttaacggttcccctttaagtttcggtaaccgttacgggtcgggggtaccaaggggtaaccttcgtacgggtccttacccggttcacccggcacgtcccaccgaccgacgggtcccttaacgttccccgg

SEQ ID NO: 358950 - DNA, 596 bp, Homo sapiens
  misc_feature: GZ8MTXP01B2PRG.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctagaagaacaggctccaccatcaccaaggaaccacctccaacaaaccgaggtcggtaccttacaatcgaaccaatatcgggaccctgtacggaacacagccacatattactgttcacgtctctagtgggttcgggtagtttagttacgtcccttagtttgacttcgtgggggtccaagggggtaaccttcgtacgggtccttaccccgttcgttccccggccacggtccctccccgaacccgaaccggggtcccccttaagtttcccccggg

SEQ ID NO: 358951 - DNA, 534 bp, Homo sapiens
  misc_feature: GZ8MTXP01DMC0G.17.33.C11.1.454.CMB.2.raw
  modified_base (296)..(296): a, c, t, g, unknown or other
  misc_feature (296)..(296): n is a, c, g, or t
  modified_base (387)..(387): a, c, t, g, unknown or other
  misc_feature (387)..(387): n is a, c, g, or t
tcagcgtagactagcacgaccggtgctcgatttagagtgagctcgttgggtttgggggcgccaggggtcccttccaatatcagcaccatggcctggacccctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttanagtacaaacaacaaacactcctggacccctgcccgattctcaggctccctcccttgggggcaaagctgcccctgcactgtctggtgtgcancctgaggacgagggctgactattactgcctactctactttgggtgggtgcgtgtgctattcgggcggaagggccaagctgaccgtctaagttcagcccaaggcttcgcccccttggtccactctgttccccgccctccttcctaacg

SEQ ID NO: 358952 - DNA, 583 bp, Homo sapiens
  misc_feature: GZ8MTXP01CSWMB.17.33.C11.1.454.CMB.2.raw
  modified_base (323)..(323): a, c, t, g, unknown or other
  misc_feature (323)..(323): n is a, c, g, or t
  modified_base (330)..(330): a, c, t, g, unknown or other
  misc_feature (330)..(330): n is a, c, g, or t
  modified_base (345)..(345): a, c, t, g, unknown or other
  misc_feature (345)..(345): n is a, c, g, or t
  modified_base (539)..(539): a, c, t, g, unknown or other
  misc_feature (539)..(539): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcctaccttctctggcttctcactcagaacgagtaggaagtgggagtgggctggactccgtcacgccccgaggaacgcctggagtgcttgcgctctattagtggatgagagagcactacacgtcgtcnctagaanaacgagctaccacanacacaagaaccacctcaacaaacgaggtcgtactacaatacaactagtacgtacggacctgacgacacgacgccaatatacttacgtcgttacacgtcttagtaggtcgggttcgggttaacttagtttaccgtcccttagttcgaccgtacggtcgggacgttagggtacttcgttcggtccttacccgttcnccgcaccgccctaccgaaccgacggtaacccgttcgttccccgg

SEQ ID NO: 358953 - DNA, 643 bp, Homo sapiens
  misc_feature: GZ8MTXP01B48P1.17.33.C11.1.454.CMB.2.raw
  modified_base (268)..(268): a, c, t, g, unknown or other
  misc_feature (268)..(268): n is a, c, g, or t
tcagcgtagactagcacgaccggtgctcgatttagagtgagctcgttgggtttgggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggtccagcagaaacnggacaagcaccagggcactctatttatagtaacaaacaacaaacactcctcggaccccctgcccgtattctcacggtcctccccccgtccgtgggggacaaacgctacgccctgacctactcgtctggtcgtgcgacgccgtggacggacgacggtctaggtacttattacctgtacctactcttacgtttggggtggttggtcttggtcgtcgttggttcggcgggtacgggaccgaaggtccgttcggtaacccgttcgtttaaacggccgttaacggacccgaacgggttccgttcccggttccccccgttaagggtccctaacgttttcccgtcccggtttaccccctaacccccgttaaccctttccccg

SEQ ID NO: 358954 - DNA, 583 bp, Homo sapiens
  misc_feature: GZ8MTXP01CTI40.17.33.C11.1.454.CMB.2.raw
  modified_base (269)..(269): a, c, t, g, unknown or other
  misc_feature (269)..(269): n is a, c, g, or t
  modified_base (294)..(294): a, c, t, g, unknown or other
  misc_feature (294)..(294): n is a, c, g, or t
  modified_base (427)..(427): a, c, t, g, unknown or other
  misc_feature (427)..(427): n is a, c, g, or t
  modified_base (512)..(512): a, c, t, g, unknown or other
  misc_feature (512)..(512): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaaaccnggacaagcaccaggcactcatttanagtaacaaacaacaaacactcctcggacccctgacccgtattctcagcctcccccgtcgttggggcaaagctaacgccctgactacgtgtcgtggtgtcgcagtccgtgaggacgaggctagtactattacgngtacctactcttacgtttgggggtgtgtcgtgtcgtcgtagttcggacgggaggaccgaaggctcggaaccgttcgttaagtccncgtacccgaacggccgttccgttcccccgtcggtacctcttccgtccgttccccgtcccttccgtaacccg

SEQ ID NO: 358955 - DNA, 624 bp, Homo sapiens
  misc_feature: GZ8MTXP01DVY2L.17.33.C11.1.454.CMB.2.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccagggaggacagtcactctcacctgtgcttccaacactggagcagtcaccagtcgcttactactaccaaactggtccagcaacgaaactggaacaagcaacccgaggaccactctaatttataacgtaacaaaacaacaaacactcctacggacccctgacccgtattctcacggcctcccccgtccgtaggggacaacgctcgccctgactacgtgtcgtggtgtgcagtccgtaggacgggacgagggtctacgtaccttaagttacctcgtaccttacttacgttacgtttgggggttggtgtcgttgtcgtcttacggttcgggacgggaccgggtaaccaagtccgtaggtaaccgtattacgcgttacgaccgacggttccgttccgcccctggtacctccgttcgtccttaccctcccgttccgttaaccg

SEQ ID NO: 358956 - DNA, 595 bp, Homo sapiens
  misc_feature: GZ8MTXP01D8EKG.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctgggatccgtcacgcccccaggaaacggccctggagtggcttgcgctctatttagtgggatgagagtaagcactacagtccgtctctagaagaacaggctccaccataccaaccaacggaaccaccctccaaacaaacccgtagggtacgtaccttaacaatacgaaccaatactcgggaaccctgtacggaacacgacgccaactatacttactgttcaacgtcttacgtagttgggttcgggtatttattacgtccttacgttgacgtacggtcgggccaggggtaccttcgtacggtccaccgttcttccgccacgccctccgaccgttacgggcccaacgttccccgg

SEQ ID NO: 358957 - DNA, 716 bp, Homo sapiens
  misc_feature: GZ8MTXP01EUNE9.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcacgcccccaggaacggccctggagtggcttgcgctctatttatgggatgagagtaagcactacagtcccgtctcgtagaacgaacaggcctaccaccatacaacccaaacggaaacccaccctcccaaacaaacccgagggtacgtaccttaacaaatacgaacctaaatacgtacggacccttggtacggaaccacgaacgacccaactaacttaacttaaccgttcgtttaccaacggttcctttaccgttaaggttcgggggtttacgggggtaacgtttttaacgtttaaccggttcccctttaaacgttttcggtaaccgtttaccgggtaacgggggtaacccgttaagggggtaaaccttcgggtacgggttacccaccccggttccgttacccggccgtaaccggtccccttacccgaacccggttaaccggggtccccttaacgttcccccggg

SEQ ID NO: 358958 - DNA, 549 bp, Homo sapiens
  misc_feature: GZ8MTXP01AQN15.17.33.C11.1.454.CMB.2.raw
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (276)..(276): a, c, t, g, unknown or other
  misc_feature (276)..(276): n is a, c, g, or t
  modified_base (525)..(525): a, c, t, g, unknown or other
  misc_feature (525)..(525): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtcagcagaacnganagcaccnggcactcatttatagtaacaaacaaacaaacactcctaggaccctctcgcccgtattcctcgacggccctcccctcgttgggggacctaaagctcgccctgacacgtgtcgtgggtgtacgcagccgtggacggacgaggcgtagacgtattactcgactactcttacgttggtggtgtctgtgctgtcggcggtacggtacaagcgtgaccgttctaacgcgacgccgacgcttccgcccctggtccncgtcttccgttcccgcccttcccg

SEQ ID NO: 358959 - DNA, 556 bp, Homo sapiens
  misc_feature: GZ8MTXP01A24PC.17.33.C11.1.454.CMB.2.raw
  modified_base (394)..(394): a, c, t, g, unknown or other
  misc_feature (394)..(394): n is a, c, g, or t
  modified_base (418)..(418): a, c, t, g, unknown or other
  misc_feature (418)..(418): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaggccctggagtggcttgcgctcatttatgggatgagagtaagcactacagtccgtctctagaagaacaggctccaccatcaccaagaaccacctccacaaaccaggtcgtacctacaatgaccaatacncggaccctgtacggacacagccanatattactcgttacacgtctctagttgggttcggggtatttagttacgtcccttatttgactacgtggggccaggggtaacttcgtcggtcaccgttcttccgctacgcctccaccgttacgggcccaagttccccgg

SEQ ID NO: 358960 - DNA, 696 bp, Homo sapiens
  misc_feature: GZ8MTXP01CG9PL.17.33.C11.1.454.CMB.2.raw
  modified_base (286)..(286): a, c, t, g, unknown or other
  misc_feature (286)..(286): n is a, c, g, or t
  modified_base (332)..(332): a, c, t, g, unknown or other
  misc_feature (332)..(332): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactacggcacgaccccaggaacgcctggagtgcttgcgctnattagtggatgagagtagcactacagtccgtctcgtagaacgaacncggcaccaccatacaccaacggaaccacccaaccaacgaaaccgcggtacgtaccttaacaacgttacaaccctaaattacgacgggtaccccttaggtcgggaaaccccaacgaccgtaaccctaaacttacgttaacgttacgttaccgttacgaccgttcggtttacgttacgggttaccggggtttaccgggttacgttttacgtttacccgttaccgttacgtttacgtaccgttacgggtcggggtaaccgttaacgggtacccgttcggttaccggtacccgttccccggttcgttcccgtaaccgtacccgtaacccgtacccgtacccggacccggtaacccgttcccgttcccg

SEQ ID NO: 358961 - DNA, 583 bp, Homo sapiens
  misc_feature: GZ8MTXP01EC3KB.17.33.C11.1.454.CMB.2.raw
  modified_base (267)..(267): a, c, t, g, unknown or other
  misc_feature (267)..(267): n is a, c, g, or t
  modified_base (292)..(292): a, c, t, g, unknown or other
  misc_feature (292)..(292): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggtccagcagaaacnggacaagcaccaggcactcatttanagtacaaacaacaaacactacctggaccccctgcccgattcctcacggcctccccccgtccgttgggggacaaagctcgccctgacactgtctggtgtgcagcctggaggacgaggctagactattactgcctactcttacgtttggggtgtgtctgtgtctagttcggcggtagggtaccaagtctcggtaaccgttacttaacgtcacgccccgtaaaggcccgttccggcccccgttcggtcctaaccgttccttcccgttcccctaaccccgttccctttaaccccg

SEQ ID NO: 358962 - DNA, 667 bp, Homo sapiens
  misc_feature: GZ8MTXP01D225A.17.33.C11.1.454.CMB.2.raw
  modified_base (270)..(270): a, c, t, g, unknown or other
  misc_feature (270)..(270): n is a, c, g, or t
  modified_base (293)..(293): a, c, t, g, unknown or other
  misc_feature (293)..(293): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttccaacactggagcagtcacagtgcttactatccaaactggtccagcagaaaccnggacagcaccaggcactcattanagtacaaacaacaaacactcctaggacccctgcccgtattctcacggcctcccccgtccgttgggggacaaagctacgccctgacacgtgtctggtgtgcagcctagacggacgaggctagaacttattactgtaccttactctttaccgttttgggggtggttgtccgttggtcgtcgttaacgttccgggggaccgggtaacgggggtaacctaaacgggtccgttacggggtaaccccgtttacgtttaaaacgggttcccaaacgggacccccgtaaacgggggttcccttcccgggttaccccccccgttcggggtaccctaacctttcccgtcccggtttccccccgtccccttccccgtttccccgg

SEQ ID NO: 358963 - DNA, 672 bp, Homo sapiens
  misc_feature: GZ8MTXP01BOW64.17.33.C11.1.454.CMB.2.raw
  modified_base (326)..(326): a, c, t, g, unknown or other
  misc_feature (326)..(326): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccggtcacgccccaggaacggccctggagtggcttgcgctctatttagttgggatgagagtaagcactacagtccgtntcgtagaagacaggctaccaccatccaaccaaggaaccacccgtccaaacaaacccgagggtacgtaccttaacaaatacgaacctaaatacgtacggaccccttggacggaaccaacgaacgacccaactattaacttaccttcggttaccaacgtcttaccgttaaggttcggggtttaccggggtatttaacgtttaccgttcccttaacgtttacgaccgttaacggtcgggggaacccttaagggggtaaaccttcggtacgggtcccttaaccggttcccgttacccgaactaccgtaacccgtacccgaaccggaccgggtcccgttaacggttcccgg

SEQ ID NO: 358964 - DNA, 626 bp, Homo sapiens
  misc_feature: GZ8MTXP01BFKEC.17.33.C11.1.454.CMB.2.raw
  modified_base (349)..(349): a, c, t, g, unknown or other
  misc_feature (349)..(349): n is a, c, g, or t
  modified_base (598)..(598): a, c, t, g, unknown or other
  misc_feature (598)..(598): n is a, c, g, or t
  modified_base (603)..(603): a, c, t, g, unknown or other
  misc_feature (603)..(603): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctggcttctcactcagaacgagtggaagtgggagtgggctggactccgcacgccccgaggaacggcctggagtgcttgcgctcattatgggatgagagtaagcactacagtccgtctctagaaagaacacggcctaccaccganaccaacccgaacggaacccaaccctcccgaaacaaaaccgtacgggttacgtaccttaaacaacgtacgaaaccctaagttacgtacgaacccgttagtacggaaccacacgacccaatacgttaatttacgtcgttacacggttctaccgtagttggttaccggggtagtttaatttaccgttccgttactttacgtaccttacggtcgggtacgacgggtaacttcgtcggtcaccgttccacgccncgccnccgaccgaccgtccgttcgtccg

SEQ ID NO: 358965 - DNA, 682 bp, Homo sapiens
  misc_feature: GZ8MTXP01AIYJO.17.33.C11.1.454.CMB.2.raw
  modified_base (321)..(321): a, c, t, g, unknown or other
  misc_feature (321)..(321): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagacccctcacgctgacctgcaccttctctggcttctcactcagaacgagtggaatgggagtgggctgggactccgcacgcccccgaggaaacggccctggagtggcttgcgctcatttattgggatgagagtaagcactacngtccgtctctgaagacaggctaccaccagtaccaaccaaaggaaccaccctccaaacaaaccagggtcgtaccttaacaaattcgaaccctaaagtacgtcggaacccctggtacggaaccacgagacccaacacttaattacttcgttcaacggtctcttagtcgggtttcggggtatttacgtttaccgttcccttacgtttcgaaccgttacggtcgggggtaccgttaacgggggtaaaccttccggttacgggttacccgacccggttccccgttacccggtcccgtaaccgggccccccttaccccgaaaccccggaaaccgggggtcccccccttaagggttttcccccccggg

SEQ ID NO: 358966 - DNA, 744 bp, Homo sapiens
  misc_feature: GZ8MTXP01ALQT4.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctggcttctcactcagaacgagtggaagtggggagtgggctggactccggtcacgcccccgaaggaaacggccctggagtggcttgcgctctatttagttgggatggagagtaagcactacagtccgtctcgtagaaagaacgacggcctaccccaccactaccaacccgaaacggaaacccaacccctaacccaaaccgaaaacccgtacgggttacggtaaccttaacaaactacgaaaccctaaatacggtacggtaccccttaggacggaaccacgacgacccaatacttaacttacttcggttaccaacgtccgtttacgtaagggtttcggggttaccggggttaaagttttaacgtttaacccggtttacccctttaacgttttacggtaaccgttaccgggtaacgggggtaacccgttaaacgggggtaccctttcggtcggggtaccccttacccggttccgttccccggcgaccggtcccctacccgaacccgggttaacccggggtccccttaacgtttcccccggg

SEQ ID NO: 358967 - DNA, 543 bp, Homo sapiens
  misc_feature: GZ8MTXP01ALXS8.17.33.C11.1.454.CMB.2.raw
  modified_base (297)..(297): a, c, t, g, unknown or other
  misc_feature (297)..(297): n is a, c, g, or t
  modified_base (419)..(419): a, c, t, g, unknown or other
  misc_feature (419)..(419): n is a, c, g, or t
  modified_base (519)..(519): a, c, t, g, unknown or other
  misc_feature (519)..(519): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtacaaacaacaaacactcctggacccctgcccgattctcaggctccccctccgttgggggcaaagctcgccctgacactgtctggtgtgcagcctggaggacgagggctgactattacgncctacttctactttggggtggtgctgtgctagttcgggcgggacggtaccaagcctggaaccgtcttaaagtccagccccaaggcttcgcccctcggtcnctctcgttcccgtcccttctcccg

SEQ ID NO: 358968 - DNA, 560 bp, Homo sapiens
  misc_feature: GZ8MTXP01AS5VQ.17.33.C11.1.454.CMB.2.raw
  modified_base (387)..(387): a, c, t, g, unknown or other
  misc_feature (387)..(387): n is a, c, g, or t
  modified_base (425)..(425): a, c, t, g, unknown or other
  misc_feature (425)..(425): n is a, c, g, or t
  modified_base (527)..(527): a, c, t, g, unknown or other
  misc_feature (527)..(527): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccgaggaaaggccctggagtggcttgcgctctatttatgggatgagagtaagcactacagtccgtctctgaagaacaggctccaccatacaccaagaaccacctccaacaaaccagtgtacccccctanaactagaccaatagtacgacctgtaggacacacgccanatacttactgttacacgctctagtggttcgggtagtttagttacgtcccttatttcgacttcgtcggggcagggtaacttcgtgtccaccgttcttccggcncggccctccaccgacgggcccttaagtccccgg

SEQ ID NO: 358969 - DNA, 637 bp, Homo sapiens
  misc_feature: GZ8MTXP01BC3SP.17.33.C11.1.454.CMB.2.raw
  modified_base (331)..(331): a, c, t, g, unknown or other
  misc_feature (331)..(331): n is a, c, g, or t
  modified_base (342)..(342): a, c, t, g, unknown or other
  misc_feature (342)..(342): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctggcttctcactcagaacgagtggaatgggagtgggctggactcggtcacgccccaggaagcctggagtggcttgcgctcattatggatgagagtagcactacagtccgtcttcagaacgaacgngctacccacanaccaaccaacgaaccctaccaaccaaacgaaacgtacggtacgtacctaacaatacgaactaagtacgacgtacctagtacgaacacgacgacctaactaacttacttacgttcgtacggacgtacttacgttaggttcggggttacggttagtttaacgttaccgttccttacgttacgtaccgtacgggtcgggtaaccgttaagggtaccttcggtaccgtaccgttaccgttccgttaccgtaaccgaccgtaacccgtacccgacccgaccggtaacccgttccgtcccg

SEQ ID NO: 358970 - DNA, 622 bp, Homo sapiens
  misc_feature: GZ8MTXP01EW6WM.17.33.C11.1.454.CMB.2.raw
  modified_base (420)..(420): a, c, t, g, unknown or other
  misc_feature (420)..(420): n is a, c, g, or t
  modified_base (582)..(582): a, c, t, g, unknown or other
  misc_feature (582)..(582): n is a, c, g, or t
  modified_base (589)..(589): a, c, t, g, unknown or other
  misc_feature (589)..(589): n is a, c, g, or t
  modified_base (596)..(596): a, c, t, g, unknown or other
  misc_feature (596)..(596): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgcctaccttctctggcttctcactcagaacgagtggaatgggagtgggctggactccgcgacgaccccgaggaacgcctggagtgcttgcgctctagtttagttggatgagagtaagcaactacagtcccgtctacgtagaacgaacaggcctaccacctactacaaaccaacggaacccaaccctaaccgaaaccaaacccgtagggtacgtacccttaaanaactacgaactaatacgtacgacctgacgaacacacaccaactagttacttacgtacgttacgacgttcttacgttaggttacggggttcggttaagtttacgttaccgttaccttagttacgaccgttcggtcggggaccgttaggtaccttcgtcgtccnccgttcnccgcacnccctacaccgacgtcccttcgtcccg

SEQ ID NO: 358971 - DNA, 587 bp, Homo sapiens
  misc_feature: GZ8MTXP01B989C.17.33.C11.1.454.CMB.2.raw
  modified_base (448)..(448): a, c, t, g, unknown or other
  misc_feature (448)..(448): n is a, c, g, or t
  modified_base (554)..(554): a, c, t, g, unknown or other
  misc_feature (554)..(554): n is a, c, g, or t
  modified_base (576)..(576): a, c, t, g, unknown or other
  misc_feature (576)..(576): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcacgcccccgaggaaacggccctggagtggcttgcgctcatttatggatgagagtaagcactacgagtccgtctctagaaagaacaggctcccaccatacaaccaaggaaccaaccctcccaaacaaacccgagggttcgtacccttaacaatacgaaccctaaatactcgggaccctggtacggaacacagccanactatactgtcacgcttcgtagtggttcgggtatttattacgtcccttagttcgacgttacgtggggaccaggggtaccttgtaggtccttaccggttcttaccgnacgtccctccaccgacggtccncgtttccccgg

SEQ ID NO: 358972 - DNA, 657 bp, Homo sapiens
  misc_feature: GZ8MTXP01BN0B3.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaacggccctggagtggcttgcgctcatttattgggatgagagtaagcactacagtccgtctctagaagaacaggctaccaccatacaaccaaggaaccaccctccaacaaaccaggtcgtaccttacaatacgaacccaaatagtacggaccctggtacggaacaacacgaccaacacttattaactcgttacacgtcttcgtagttcgggttacggggtagtttacgtttacggttcccttaacgtttcggtaaccgttacggtcgggggtacccttaagggggtaaaccttccgttacgggttcccttaacccggttccgttacccggcctaccggtccccgttaccccgaacccggaaaccgggggtcccccttaacggtttcccccggg

SEQ ID NO: 358973 - DNA, 569 bp, Homo sapiens
  misc_feature: GZ8MTXP01CQUKK.17.33.C11.1.454.CMB.2.raw
  modified_base (334)..(334): a, c, t, g, unknown or other
  misc_feature (334)..(334): n is a, c, g, or t
  modified_base (437)..(437): a, c, t, g, unknown or other
  misc_feature (437)..(437): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
  modified_base (521)..(521): a, c, t, g, unknown or other
  misc_feature (521)..(521): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaatggggagtgggctggatccgtcagcccccaggaaggccctggagtggcttgcgctcatttatggatgagagtaagcactacagtcccgtctctagaagaacnggctccaccatccaaccaacggaacccaaccctccaaacaaaccgaggtcgtacctacaatacgaacccaatatacggaccctaggtacggacacacgccaanatattactgttaccngtctntagtggttcggagtttattacgtcccttattgactcgtcgggacaggggacttcgtacggtccncgttcttccgaactcgcctccgaccgttacggcccttaacgtccccgg

SEQ ID NO: 358974 - DNA, 589 bp, Homo sapiens
  misc_feature: GZ8MTXP01BKXHF.17.33.C11.1.454.CMB.2.raw
  modified_base (270)..(270): a, c, t, g, unknown or other
  misc_feature (270)..(270): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactataccaaactggttccagcagaaaccnggacaagcaccagggcactcatttatagtaacaaacaacaaacactacctaggaccccctgcccgattcctcacggccttcccccctccgttgggggacaaagctcgccctgacactgtctggtgtgcagcctggaggacgaggctagactagtactgcctatcttacgtttggggtgtgtctgtgtctagttcgggacggagggtaccgaagtctcggaaccgttcgttaacgtcttaacgcccgaacggttccgttccggttcccccgtcgggtaccctccttccttccggttcccctaaccccgttcccttccccg

SEQ ID NO: 358975 - DNA, 593 bp, Homo sapiens
  misc_feature: GZ8MTXP01ADOWV.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttatgggatgagagtaagcactacagtccgtctctagaagaacaggcctccaccatccaccaaaggaaccaccctcccaacaaacccgaggttacggtacccttaacaaattcgaaacccaattaacgtcgggaacccctggtacggacaacagccaacatattacctgttacacgcttctagttgggttcggggattattacgtccttacttgacctacgtggggccttaggggtacttcgtcggtcttaccggttcttcccggcagccctacccaccgaaccgggtcccaacgttccccggg

SEQ ID NO: 358976 - DNA, 541 bp, Homo sapiens
  misc_feature: GZ8MTXP01ARZA7.17.33.C11.1.454.CMB.2.raw
  modified_base (382)..(382): a, c, t, g, unknown or other
  misc_feature (382)..(382): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctgggatccgtcacgcccccaggaaaggccctggagtggcttgcgctcatttagttggatgagagtaagcactacagtccgtctctagaagacagctccaccatcaccaagaaccacctccacaaaccaggtcgtacctanaatcgaaccaatactacggaccctgtcggacacacgccaacatattactgttcacgtctctagtggttcgggatttattacgtcctattgactcggtgggccagggacttcgtggtccacgttcttccgcacgcctccaccgacggcccaacgtcccgg

SEQ ID NO: 358977 - DNA, 651 bp, Homo sapiens
  misc_feature: GZ8MTXP01AIHGC.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctggcttctcactcagaacgagtggaagtggggagtgggctggactccggtcgacgcccccgaaggaacggcccgtggagtggcttgcgctctatttagtggatgagtagtaagcactacagtccgtctcgtagaacgacaggctaccaccataccaaccaagaaccaccctccaaacaaaccgtaggtcgtaccttagaatcgaactaatacgtcggaccttgacggaacacgacaccaataactacttacttacggttacaacgtcgttctaacggttcggggtttaccgggggtaattttacgtttacggttacccctttaacgtttacggtaaccgttcgggtaacggggcccgttaaggggtaaccttcggtacgggtccttacccggttccttccgaaccgtcgccctaccgaccgaacgggtcccaacggtttccccgg

SEQ ID NO: 358978 - DNA, 613 bp, Homo sapiens
  misc_feature: GZ8MTXP01C86G8.17.33.C11.1.454.CMB.2.raw
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
  modified_base (430)..(430): a, c, t, g, unknown or other
  misc_feature (430)..(430): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccnggacaagcacccaggcactcatttanagtacaaacaacaaacactcctcggacccctgcccgtattcctcacggcctccccccgtccgttgggggcaaagctacgccctgaccacgtgtcgtcggtgtgcagccgtggaggacgaggctagactattacngcctactcgttacgtttgggggtggtgtctgtcgtcgttagttcggggacggacggggtaccaaggccgttggtaacccggttctttaaaggtccgacggtacccgaacgggttccttccggttcccccttccgggtccttaaccgttttcgttcccccgttcccttcccttccgtttaacgg

SEQ ID NO: 358979 - DNA, 676 bp, Homo sapiens
  misc_feature: GZ8MTXP01BCHGR.17.33.C11.1.454.CMB.2.raw
  modified_base (323)..(323): a, c, t, g, unknown or other
  misc_feature (323)..(323): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgcaccttctctggcttctcactcagaacgagtggaatggggagtgggctggactccgtcacgccccgaggaacggccctggagtggcttgcgtctctagtttagttggatgagagtaagcactacncgtccgtctcgtagaaagaacaggcctacccaccatacccgaaacccaaacggaacccaaccctaacccgaaaccgaaaacccgtacgggttacggtaacccttaacgaaatacgaaccctaaagtacgtacggaccctaggtacggaaccacgacgacccaactattaacttacgtcgttaccaacgtcgttacgttaaggttcggggtttacggggtatttacgttaccggttacccttagtttacgaccgttaacgggtcggggaccttacggggacttcggtacggtcttacccgttcgttcccgctaccgccctacccgaaccgaccgggtcccttaacgttccccgg

SEQ ID NO: 358980 - DNA, 569 bp, Homo sapiens
  misc_feature: GZ8MTXP01D4P7C.17.33.C11.1.454.CMB.2.raw
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
  modified_base (406)..(406): a, c, t, g, unknown or other
  misc_feature (406)..(406): n is a, c, g, or t
  modified_base (437)..(437): a, c, t, g, unknown or other
  misc_feature (437)..(437): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgcttccaanactggancagtcaccagtncttactatacccaaactggttaccagcaaacgaaacctggaacaagccacccgagggcactcaatttaataagtaacaaacaaacaaacactcctcgacccctcgcccgattctcacggcctccccctccgttgggggacaaagctcgccctgacactgctggtgtntacagcctggaggacgagctagactattacncgtcctacttctacgttggggttgtgtctgtgcgtgttcggaggtacgggaccagtcctggaaccttacgttaaagcacgaccgaacgcttccgccctcgcctaactctcgttccctaacccttccttcccg

SEQ ID NO: 358981 - DNA, 587 bp, Homo sapiens
  misc_feature: GZ8MTXP01DGAPZ.17.33.C11.1.454.CMB.2.raw
  modified_base (430)..(430): a, c, t, g, unknown or other
  misc_feature (430)..(430): n is a, c, g, or t
  modified_base (465)..(465): a, c, t, g, unknown or other
  misc_feature (465)..(465): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccgtcagccccaggaagccctggagtggcttgcgctcatttattggatgagagtaagcactacagtcccgtctctagaagaacaggcctaccaccatcaaccaaggaaccacctccaacaaaccaggtcgtaccttaacaatacgaaccaaatatcgggaaccctgtacggacacagcccanatattactgttcacgtctactagtggttacgggtntttagtacgttcccttatttcgacttacgtggggcccttaaggggtaccttcgtcgggtccaacccggttcttacccggcaacggtccctccccgacgaaccgggtcccaacgtttccccgg

SEQ ID NO: 358982 - DNA, 747 bp, Homo sapiens
  misc_feature: GZ8MTXP01EB5OG.17.33.C11.1.454.CMB.2.raw
  modified_base (328)..(328): a, c, t, g, unknown or other
  misc_feature (328)..(328): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcacgcccccaggaaacgccctggagtggcttgcgctctagtttagttggatggagagtaagcactacagtcccgtntacgtagaacgaacaggctaccaccataccaaccaacggaaccaccctccaaacaaacccgtacgggtacggtacccttaacaaacgttacaaccctaaattacgtaccgggaacccgttggtacgggaaaccaaccaacggcccctaaacctaaagttaaacgtttacttacggtttaacctaaaccggttccctttacgttaagggtttacgggggtttaccgggggtaatttttaacgtttaacccggtttcccctttacgttttacggaaccgttacggtaaccgggggtaccgttaacgggggtaaacctttcggtaacgggttcccttaacccgggtttccccgttacccggaacctacccggtcccctaacccggaacccggttaccgggtccccgttaaccggttccccgg

SEQ ID NO: 358983 - DNA, 671 bp, Homo sapiens
  misc_feature: GZ8MTXP01B4GTM.17.33.C11.1.454.CMB.2.raw
  modified_base (630)..(630): a, c, t, g, unknown or other
  misc_feature (630)..(630): n is a, c, g, or t
  modified_base (635)..(635): a, c, t, g, unknown or other
  misc_feature (635)..(635): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgcacgccccaggaacgcctggagtggcttgtgctctatttagtggatgagagtaagcactacacgtccgtctctagaagaacaggctaccacctactaccaaccgaaacggaaccctacccctaaccaaaccgaaaccgtacgggttacggtacctttaaccaaatacgtaaccctaaagttacgtacgggacccctggtacggaacccaacgaccgtaccaactaacgttacttaacttccggttactaaccggtcctttaccgttaggttcgggggtttaccgggggtagtttaactttaccggtacccctttaagtttcgaaccgttacggtcggggaccgttaacggggtaccttcgtacggttcacccggttccnccgcncgccctaccgaccggttaccggtcccttcggtcccg

SEQ ID NO: 358984 - DNA, 566 bp, Homo sapiens
  misc_feature: GZ8MTXP01AWDP3.17.33.C11.1.454.CMB.2.raw
  modified_base (527)..(527): a, c, t, g, unknown or other
  misc_feature (527)..(527): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgtcagcccccaggaaaggccctggagtggcttgcgctcatttatgggatgagagtaagcactacagtcccgttctctgaagaacaggctccaccatcaccaagaacacctcacaaaccagtcgtactacatcgaccaatagtcggaccctgtacggacacgacgcccaatatacttactgttacacgtcttctagtcgggttcggggtatttattacggtcccttagtttgacgttcgtggggtcccaggggtaaccttcgtacggtcacccgttcncccgcacgccctaccaccgacgggtcccaagttccccgg

SEQ ID NO: 358985 - DNA, 597 bp, Homo sapiens
  misc_feature: GZ8MTXP01DWOAR.17.33.C11.1.454.CMB.2.raw
  modified_base (267)..(267): a, c, t, g, unknown or other
  misc_feature (267)..(267): n is a, c, g, or t
  modified_base (291)..(291): a, c, t, g, unknown or other
  misc_feature (291)..(291): n is a, c, g, or t
  modified_base (336)..(336): a, c, t, g, unknown or other
  misc_feature (336)..(336): n is a, c, g, or t
  modified_base (428)..(428): a, c, t, g, unknown or other
  misc_feature (428)..(428): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtcagcagaaacnggacaagcaccaggcactcattanagtaacaaacaacaaacactcctacggacccctgcccgtattccncacggcctaccccctccggttggggacaaacgcctacgccctgactactcgtctggtgtcgcacgccgtgacggacgagctagtactattcncgtccttactcttacgtttggggtggtgtcttgtcgtcgttagttcgggacgggaacggtaccaagccgtaggtaaccgtacttacggcaacggaccccgtaaggcccgttccgcccccgttggtccctaaccgttcctccgttcccctaaccccgttccttaaccccg

SEQ ID NO: 358986 - DNA, 657 bp, Homo sapiens
  misc_feature: GZ8MTXP01CFHFI.17.33.C11.1.454.CMB.2.raw
  modified_base (455)..(455): a, c, t, g, unknown or other
  misc_feature (455)..(455): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccgaggaaggccctggagtggcttgcgctctatttagtggatgagagtaagcactacagttccgtctcgtagaaagaacaggacctacccaccataccaaccaaaggaaccaaccctccaaacaaacccgtagggtcgtacccttaacaaattacgaacctaatactacggaccctgtaggaacacacgtacccaanataacttactcgttacacgtcttacgttaagtcgggtttacggggactttaagttaccggttaccctttacgtttcggtaaccttacgggtcgggggtacccttagggggtaaccttccggtcgggttaccaccccgggttcttaccccgcgaccgtcccctacccgacccgttaaaccgggccccttaacggttcccccgg

SEQ ID NO: 358987 - DNA, 622 bp, Homo sapiens
  misc_feature: GZ8MTXP01B7A30.17.33.C11.1.454.CMB.2.raw
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
  modified_base (441)..(441): a, c, t, g, unknown or other
  misc_feature (441)..(441): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtcaccagtgacttactactaccaaactggttccagacaagaaaccnggaacaagccacccgaggcactcatttanagtaacaaacaacaaacactacctcgacccctcgccgattctcacggtcctcccccgtccggttaggggacaaacgcgtacgccctgactacgtgtctggtgtgcacgctggaggacgacgcacgtactattacncgtcctacttcttacgtttggggtggtgtcgttgtgtcttaggttcgggacgggacggtaaccgacgtccgtcggtaacccgttagttaacggtcaacggtacccgaacggttccgttccgttacccccgttcgggtccctaaccttcccgtccgttcccccgtcccgttccttaaccccg

SEQ ID NO: 358988 - DNA, 677 bp, Homo sapiens
  misc_feature: GZ8MTXP01B4HDY.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcaagaacgagtggaatggggagtgggctgggactccgtcacgcccccaaggaaaggccctggagtggcttgcgctctagtttagttgggatggaagagtaagcaactacacgtccgtctcgtagaagaacaggcctacccaaccataccaaccgaaagaacccaaccctccaaacgaaaccgagggtacgtaccttaacaaactacgaaacctaagtagtaccgggacccttaggacgaaccaacgtacaccctaactaattaagtttacttacgttacaaccgttcctttcgtaaggtttggggttaaccggggtatttacgttacgttccccttagttgaaccgttcgggtaacggggtacccgaagggtaaccttccggtacggttacccgacccggtttcccgcccgaacctaccgtcccgacccgacccggaccggtaacccgttcccgtcccg

SEQ ID NO: 358989 - DNA, 546 bp, Homo sapiens
  misc_feature: GZ8MTXP01A2CT4.17.33.C11.1.454.CMB.2.raw
  modified_base (332)..(332): a, c, t, g, unknown or other
  misc_feature (332)..(332): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaaggccctggagtggcttgcgctcatttattgggatgagagtaagcactacagtccgtctctgaagaacnggctccacatcacagaacacncacaaacngtgtctanatnacanatgacctgngacacagccanatattactgttcacgtcttctagttgggttacggggagtttattacgttcccttaactttcgtacttaacgtcgggggtccagggggtaaccttcgtcggtcacccggttcttcccggcacgccctccaccgacgggtcccaagttcccg

SEQ ID NO: 358990 - DNA, 546 bp, Homo sapiens
  misc_feature: GZ8MTXP01DDKOG.17.33.C11.1.454.CMB.2.raw
  modified_base (269)..(269): a, c, t, g, unknown or other
  misc_feature (269)..(269): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
  modified_base (514)..(514): a, c, t, g, unknown or other
  misc_feature (514)..(514): n is a, c, g, or t
tcagcgtagactagcacgaccggtgctcgatttagagtgagctcgttgggtttgggggcgccaggggtcccttccaatatcagcaccatggcctggactcctctctttctgttcctcttcacttgctgcccagggtccaattctcagactgtggtgactcaggagccctcactgactgtgtccccaggaggacagtcactctcacctgtgcttccaacactggagcagtcaccagtgcttactatccaaactggttccagcagaaaccnggacaagcaccaggcactcattatagtaacaaacaacaaacactcctcggacccctgcccgtattcctcaggtcctcccctccgtggggcaaagctacgcctgacactgtctggtgtgcagctgaggacgngctgactatacngctactctacgttggggtggtgtctgtgctgttcggacgggaggtaccaaggctcggaaccgttcttagtcacgccgaacggcgttccgccccgtcggtacnccttctccgttccccgtcccttcccgttaacc

SEQ ID NO: 358991 - DNA, 638 bp, Homo sapiens
  misc_feature: GZ8MTXP01AEGV4.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgtcacgcccccaggaaaggccctggagtggcttgcgctcatttatggatgagagtaagcactacagtccgtctctagaagaacaggctccaccatacaccaaggaaccaccctccaacaaaccgaggtcgtaccttaacaatacgaacccaatacgtacggacccctggtacggaccaacgagacccaactattaattactggttacacgtctacttacgttgggttcgggggtagttaacgtttacgtccctttactttagtaccgttacggtcgggggtccgttacgggtaccgttacgtcgggttacgttaccccgttccgttcccgccgacgtccccgttcccgaacccgaccggggtaaccccgttaaccggtttcccccggg

SEQ ID NO: 358992 - DNA, 642 bp, Homo sapiens
  misc_feature: GZ8MTXP01AM4O2.17.33.C11.1.454.CMB.2.raw
  modified_base (185)..(185): a, c, t, g, unknown or other
  misc_feature (185)..(185): n is a, c, g, or t
  modified_base (388)..(388): a, c, t, g, unknown or other
  misc_feature (388)..(388): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctnacgctgacctgcaccttctctggcttctcactcagaacgagtggaatggggagtgggctggactccgtcacgcccccaggaacgccctggagtggcttgcgctcatttatgggatgagagtaagcactacagtccgtctctagaagaacaggctccaccatcaaccaaggtaaccacctccaacaaaccaggtcgtaccttanaatcgaccaatactcggaaccctggtacggaacacgacgacccaacaacttacttaacttggttaccaacggtcttcgtaaggttgggttaccgggggatttacgttacgttcccttacgtttcgacgttacggtcgggggtaccagggggtaaaccttcggtcgggtacccttacccgggttcccgttcccggaaccgaccgtaaccccgtacccgaacccggttaccgggtccccgttaaccggttccccgg

SEQ ID NO: 358993 - DNA, 605 bp, Homo sapiens
  misc_feature: GZ8MTXP01EBLDR.17.33.C11.1.454.CMB.2.raw
  modified_base (276)..(276): a, c, t, g, unknown or other
  misc_feature (276)..(276): n is a, c, g, or t
  modified_base (394)..(394): a, c, t, g, unknown or other
  misc_feature (394)..(394): n is a, c, g, or t
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttaccaacactggagcagtcaccagtgcttactataccaaactggttccagcaagaaaccngaacagcaccgaggcactctattatagtaacaaacaacaaacactccgtacggacccctgcccgattcctcacggtcctcccccgtcgtggggacaaacgctcgccctgacactgtcnggtgtgcacgcctggacggcgaggctagacttagtactcgaccttatcttacgtttgggggtgtgtcttggtcgtcgttacggttcgggacggggaaggtacccgaagtcgtacggtaaccgtctttaacggcgttacgacccgtaacgccgttcccgaccccgtcggtacctccttccgtccgttaccccgtccccttcccgttaacccg

SEQ ID NO: 358994 - DNA, 677 bp, Homo sapiens
  misc_feature: GZ8MTXP01DL83J.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtgggagtgggctggactccgtcacgccccgaggaacgcctggagtggcttgcgtctctatttagtggatgagagtaagcactacagtccgtctctagaaacgaacaggcctaccaaccataccaaacccgaaacggaaacccaaccctaacccgaaacctaaaacccgaagggttacggtaccttaacgaaactacgaaacctaaagtacttacggaacccctggtacggaaaccaccgagacccaactattaacttaacgtcgttacaacggtcttacgttaaggttggggtttaaccggggtagttttaacgtttaacgttcccctttaactttggaacctttcgggtcggggaccgttaagggggtaaccttcggtacggtccttacccggttcttcccgctacgccctacccgacgttaaccgggcccttaagttccccgg

SEQ ID NO: 358995 - DNA, 668 bp, Homo sapiens
  misc_feature: GZ8MTXP01ACVB3.17.33.C11.1.454.CMB.2.raw
  modified_base (292)..(292): a, c, t, g, unknown or other
  misc_feature (292)..(292): n is a, c, g, or t
  modified_base (652)..(652): a, c, t, g, unknown or other
  misc_feature (652)..(652): n is a, c, g, or t
tcagcgtagactagcacgaccggtgctcgatttagagtgagctcgttgggtttggggggcgccaggggtcccttccaatatcagcaccatggcctggacccctctctttctgttcctcctcacttgctgcccagggtccaattctcagactgtggtgactcaggagccctcactgactgtgtccccaggaggacagtcactctcacctgtgcttccaacactggagcagtcaccagtgcttactataccaaactggttccagcagaaacctggacaagccacccaggcactnatttatagtaacaaacaacaaacactcctcggacccctgcccgattcctcacggcctcccctcccggttacggggggacaaaacgtccttcggaccccttaggaaccctacgttcggtcgtcgggtgttcggcgaacgtcccgtagggaacgggaccggacgggcttacggtaacttaacttaacgtccggtacccttaacgttcccttaaggttttcgggtgggggttcgtccgttggtcgtacgttacgttcggggcggggtaacgggaaccgtacggtaccgtacggtacccgttaacgttaaggttccacgcccgaaggtccgttccgccccgttcgtcacctcgttcccgtcccnccctcgttccgtaacg

SEQ ID NO: 358996 - DNA, 657 bp, Homo sapiens
  misc_feature: GZ8MTXP01DD5LJ.17.33.C11.1.454.CMB.2.raw
  modified_base (272)..(272): a, c, t, g, unknown or other
  misc_feature (272)..(272): n is a, c, g, or t
  modified_base (298)..(298): a, c, t, g, unknown or other
  misc_feature (298)..(298): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttaccaacactggagcagtcaccagtgcttactatccaaactggtccagcaagaaacngaacaagcaccaggcactctatttanaagtaacaaacaaacaaaccactaccctacggacccctagcccgtattacctcgacggtcctaccccccgtccgttagggggacctaaagcctacggccctcggaacctacttcgtcgtggtcgtgccagccgtggaacggacgacggctagtaaccttattactcgtacctacttacgttacgtttgggggtcggttgtcgttgtgtccgttagttacggtacgggacggtaaccgaacgtccgtacggtaaccgttacgttaaggtaccgacgtacccgaacgggttccttacccggttcccccgttcgggtaccctccttccgtcccggttccccgtccccgttcccgttaacccg

SEQ ID NO: 358997 - DNA, 710 bp, Homo sapiens
  misc_feature: GZ8MTXP01BAEVY.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtgggagtgggctggatccgtcacgccccgaggaacggccctggagtggcttgcgtctctatttagtggatgagagtaagcactacgacgtccgtctcgtagaagaacgaggcctacccaaccataccaaccgaaacggaacccaccctcccaaacaaacccgacgggtacgttacccttaacgaaactacgaaaccctaaagttacgtacgggtaaccccgttaggtacgggaaacccacgacgaccctaaactaacttactttaaccgttcgtttaccgaaccggttacctttcgttaacggttaggggttacccgggggttaagtttaacgtttaccgttaccccgtttacgttttacgaacccggttacgtaacgggggtaccaacggggtaaccttccggttcggtccccttaccgttcccgttacccgccgtaccgccctacccgacccgaccgggtcccttccggttccccg

SEQ ID NO: 358998 - DNA, 557 bp, Homo sapiens
  misc_feature: GZ8MTXP01A27ZX.17.33.C11.1.454.CMB.2.raw
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (340)..(340): a, c, t, g, unknown or other
  misc_feature (340)..(340): n is a, c, g, or t
  modified_base (418)..(418): a, c, t, g, unknown or other
  misc_feature (418)..(418): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccnggacaagcacccagggcactcatttanagtacaaacaacaaaacactacctggacccctgcccgattctnaccggctccccctccttgggggcaaagctgcccctgacactgtctggtgtgcagcctgaggacgaggctgactatacngtcctactcttacgttggggtggtcgctgtgtctagttcggcggacgggaccaaggctagtaaccgtcttaaacgtcgagcccgaagggcccttcgccccctcgggtcctaactccttgttccccaacttaacgttccc

SEQ ID NO: 358999 - DNA, 574 bp, Homo sapiens
  misc_feature: GZ8MTXP01BCSUI.17.33.C11.1.454.CMB.2.raw
  modified_base (275)..(275): a, c, t, g, unknown or other
  misc_feature (275)..(275): n is a, c, g, or t
  modified_base (303)..(303): a, c, t, g, unknown or other
  misc_feature (303)..(303): n is a, c, g, or t
  modified_base (509)..(509): a, c, t, g, unknown or other
  misc_feature (509)..(509): n is a, c, g, or t
  modified_base (558)..(558): a, c, t, g, unknown or other
  misc_feature (558)..(558): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggacgccctcactgactgtcgtccccgaggagggacagtcactctcacctgtgcttccaacactggagcagtcaccagtgacttactataccaaactggtccagcaagaaaccnggacaagccaccgaggcactctatttanacgtaacaaacaacaaacactcctcggacccctgcctattctcgacggtcctcccccgtcgttgggggactaaacggtcaccctgaactactgtcgtgggtgtcgcacgccgtaggacggacgaggctgtaacttagttactcgtaccttatcttacgttggtgggtgtcgtgtgacgtgtcggcggacggacagtctcgaccgtnttaagcacgccgaggcttccgccccttcggtctactcgttccgtacccnccctccttccgtaacg

SEQ ID NO: 359000 - DNA, 631 bp, Homo sapiens
  misc_feature: GZ8MTXP01DPC0V.17.33.C11.1.454.CMB.2.raw
  modified_base (185)..(185): a, c, t, g, unknown or other
  misc_feature (185)..(185): n is a, c, g, or t
  modified_base (288)..(288): a, c, t, g, unknown or other
  misc_feature (288)..(288): n is a, c, g, or t
  modified_base (307)..(307): a, c, t, g, unknown or other
  misc_feature (307)..(307): n is a, c, g, or t
  modified_base (403)..(403): a, c, t, g, unknown or other
  misc_feature (403)..(403): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctnacgctgacctgctaccttctctgcttctcactcagaacgagtggaagtgggagtgggctggactccgtcacgccccaggaacgcctggagtgcttgcgacttntattagtggatgagagtanacactacgacgtccgtctacgtagaagacgacgctacccaccacaccaaccgaacgaacccaccctaaccaaacaaacgtacggtacgtacctaanaatacaactaagtacgtacgaccgtagacgacacaacgaccatatacttactcgttacgacgtcttacgttaggttcggggttacgggttagtttacgttaaccgttacccgttacgtttacgtacgttacggtaacggggtacgttaacgggtacgttcgtcggtaccttcccgttccttccgccgtaccgcccgtacccgaaccgaccggtcccttaacgttcccg

SEQ ID NO: 359001 - DNA, 659 bp, Homo sapiens
  misc_feature: GZ8MTXP01DDZSK.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaatgggagtgggctggatccgtcacgcccccaggaaacggccctggagtggcttgcgctctatttatgggatgagagtaagcactacagtccgtctctagaagaacaggctacccaccactaccaacccgaaacggaacccaaccctaacccaaaccgaaaacccgtacgggttacggtacccttaaacgaaatacgaaccctaaagtagtacggaccctgtacggaacaacacgaccacattattaactgttacacgtctacgtagtggttcggggtatttagttacgttcccttagtttcgacttacgggtcggggaccgaaggggtaaccttccggttacggtccttacccgggttccttacccggcctaaccggcccccttacccgaaccccggttaaacggggtcccccaacggtttcccccgg

SEQ ID NO: 359002 - DNA, 624 bp, Homo sapiens
  misc_feature: GZ8MTXP01A9PYR.17.33.C11.1.454.CMB.2.raw
  modified_base (311)..(311): a, c, t, g, unknown or other
  misc_feature (311)..(311): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccgaggaaacggccctggagtggcttgcgctcatttattgggatgagagtaancactacagtcccgtctctagaagacaggctccaccatccaaccaacggaaccaccctccaaacaaaccgaggtcggtaccttacaaatcgaaccctaatatacggaccctggtaggaaccacacgaccaatataacttactcgttacaacgtctacgtagttgggttacggggtatttagttacgttccccttagtttcgaccttacggtcgggggcccttaagggggtaaccttcggtcgggttcacccgggttccttacccggcacggccccttacccgaccggaacggggtccccttaacgtttccccgg

SEQ ID NO: 359003 - DNA, 624 bp, Homo sapiens
  misc_feature: GZ8MTXP01CDQYX.17.33.C11.1.454.CMB.2.raw
  modified_base (270)..(270): a, c, t, g, unknown or other
  misc_feature (270)..(270): n is a, c, g, or t
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacataccaaactggtccagcaagaaccnggacagcaccaggcactcatttanataacaaacaacaaacactcncggacccctgcccgattctcacggtcctccccctccgtaggggcaaagcctacgccctgacactcgtctggtgtgcgacgccgtgacggacgagcgtagacttattactcgtcctactcttacgtttggggtgttgtcttaggtcgtcgtacgttcgggaccgggtaagggtaacccgaacggtcgtacggtaacccgttacgtttaaacggtccgaacgtaacccggacgggttcccgttccggttccccccgttcgggtccctaaccgttcccgttccccgttccccgtccccgttccctttccccg

SEQ ID NO: 359004 - DNA, 609 bp, Homo sapiens
  misc_feature: GZ8MTXP01CT9AX.17.33.C11.1.454.CMB.2.raw
  modified_base (585)..(585): a, c, t, g, unknown or other
  misc_feature (585)..(585): n is a, c, g, or t
  modified_base (600)..(600): a, c, t, g, unknown or other
  misc_feature (600)..(600): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccgaggaaacggccctggagtggcttgcgctctatttagtggatgagagtaagcactacacgtccgtctcgtagaaacgaacaggcctcccaccactccgaaacccaaacggaaacccaccctaacccaaacgaaacccgagggttacgtaccgtaacaaactacgaaccaatatacggaccctgtacggacacagaccacaatattaactcgttacacgtcttacgtaagtgggttacggggtagtttagtttacgtcccttagtttcgacgttcgtggggacccaggggtaacttcgttcggtcacccgttcttccgcacgtccnccaccgacggtcccngttccccgg

SEQ ID NO: 359005 - DNA, 541 bp, Homo sapiens
  misc_feature: GZ8MTXP01C3VRE.17.33.C11.1.454.CMB.2.raw
  modified_base (266)..(266): a, c, t, g, unknown or other
  misc_feature (266)..(266): n is a, c, g, or t
  modified_base (334)..(334): a, c, t, g, unknown or other
  misc_feature (334)..(334): n is a, c, g, or t
  modified_base (415)..(415): a, c, t, g, unknown or other
  misc_feature (415)..(415): n is a, c, g, or t
  modified_base (435)..(435): a, c, t, g, unknown or other
  misc_feature (435)..(435): n is a, c, g, or t
  modified_base (444)..(444): a, c, t, g, unknown or other
  misc_feature (444)..(444): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggtccagcagaacnggacaagcaccaggcactcatttatagtaacaaacaacaaacactcctacggacccctgcccgattcncacgctccccctccgtggggcaaacgctagcccctgaccactgtctggtgtgcagccctggaggacgaggctgactatacngcctactctacgtttggggngttgctgtntctagttcggacggaggtaccaagctcgtaaccgtcttaacgtcgacgcccgaacgcgttcgccccgtgtcaactctcgttccctcccgttcctccg

SEQ ID NO: 359006 - DNA, 568 bp, Homo sapiens
  misc_feature: GZ8MTXP01CPQJG.17.33.C11.1.454.CMB.2.raw
  modified_base (345)..(345): a, c, t, g, unknown or other
  misc_feature (345)..(345): n is a, c, g, or t
  modified_base (504)..(504): a, c, t, g, unknown or other
  misc_feature (504)..(504): n is a, c, g, or t
  modified_base (537)..(537): a, c, t, g, unknown or other
  misc_feature (537)..(537): n is a, c, g, or t
  modified_base (548)..(548): a, c, t, g, unknown or other
  misc_feature (548)..(548): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcacctttctctggcttctcactcaagaacgagtggaatggggagtgggctggatccgcacgccccaggaaagccctggagtggcttgcgctcatttatgggatgagagtagcactacagtcctctctagaaagaacaggctaccaccanacaaccaaaggaaccaacctccaacaaaccgaggtacgtaccttaacaaatcgaaccaaatactcggaccctagtacggaacacagaccactaatacttaacctgttaccaacgtctcgtagtgggttacgggtagttattacgtcctagttgactagnggggtcagggtacttcgtcgtcttaccgttccnccgctccgccnccgacgaccgtccgcgtccg

SEQ ID NO: 359007 - DNA, 581 bp, Homo sapiens
  misc_feature: GZ8MTXP01AYT88.17.33.C11.1.454.CMB.2.raw
  modified_base (422)..(422): a, c, t, g, unknown or other
  misc_feature (422)..(422): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctccaccatcaccaaggaaccaccctccacaaacccaggtcggtaccttacaatagaccaatatcggaccctgtagacacagcccanatattactgttcacgctctagtgggttcgggatttacttagtccccttagtttcgaccgttcgtcgggggcccagggggtaaccttcgtacggtcccacccggttcttacccggcacgtcccctcccgacccgaacggggccccttaacgttccccggg

SEQ ID NO: 359008 - DNA, 598 bp, Homo sapiens
  misc_feature: GZ8MTXP01DCUYU.17.33.C11.1.454.CMB.2.raw
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactataccaaactggttccagcaagaaaccnggacaagcaacccagggcactcatttanagtaacaaacaaacaaacactcctcggacccctgcccgtattctacagcctcccccgtccgttggggacaaagctacgccctgacacgtgtcgtggtgtgcacgccgtggaggacgaggctagacttatactcgcctacttcttacgttggggtggtgtctgtgtcgtgttcggacgggtacggaaccgaagccgtacggtaaccgttacgttacgtcgacgtacccgaacggttcccgttcccgccccgttcggcctaaccgttcctccgttcccctaacccgttcccttaacccg

SEQ ID NO: 359009 - DNA, 600 bp, Homo sapiens
  misc_feature: GZ8MTXP01DLFK3.17.33.C11.1.454.CMB.2.raw
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
  modified_base (339)..(339): a, c, t, g, unknown or other
  misc_feature (339)..(339): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggaggacagtcactctcacctgtgcttaccaacactggagcagtcaccagtgcttactatccaaactggtccagcagaaaccnggacaagcaccaggcactcatttanagtaacaaacaacaaacactcctacgacccctcgcccgtattcncacgcctccccctcgttggggacaaacgctacgccctgacctacgtcgtctggtgtgcagccgtggacggacgaggctagtacttatactcgtcccttaactctttacgtttggggtggtcgtcgtgtcgtcttaggttcgggacgggaacggtaccgaagtcgtcggtaaccgttacgttaaagtccacgaccctaacggcttccggccccttaacggtccaaccgttcctcccgttcccctaacccttccgttaacccg

SEQ ID NO: 359010 - DNA, 584 bp, Homo sapiens
  misc_feature: GZ8MTXP01AN7WH.17.33.C11.1.454.CMB.2.raw
  modified_base (366)..(366): a, c, t, g, unknown or other
  misc_feature (366)..(366): n is a, c, g, or t
  modified_base (395)..(395): a, c, t, g, unknown or other
  misc_feature (395)..(395): n is a, c, g, or t
  modified_base (541)..(541): a, c, t, g, unknown or other
  misc_feature (541)..(541): n is a, c, g, or t
  modified_base (550)..(550): a, c, t, g, unknown or other
  misc_feature (550)..(550): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgcttctcactcagaacgagtggaagtgggagtgggctggactccgcacgaccccaggaacggcctggagtggcttgcgctctatttagtggatgagagtagcactacacgtccgtctctagaagacaggctcccaccataccaaccgacgaacctacccnccgaaacaaaccgtaggtcgtaccttaanaagtacaaccctaagtactcgggaccctggacgacaacgacaccaactatacgttactgttacacggtctcgttagtcgggttcggggtattacgttacgtcccttaagtttcgactggtcgggacagggtaccttcgtcggtacnccgttcccnccgcgcctcccgccgacgaccgtccttcgtcccg

SEQ ID NO: 359011 - DNA, 668 bp, Homo sapiens
  misc_feature: GZ8MTXP01D8BZV.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtcccagggaggacagtcactctcacctgtcgtcttaccaacacgtggagcagtccacctagtgtacttactataccaaacgtcggtacagacaacaacgacgaacgacgaccaccgacggactactacttaattaagtaacaaacctaaacaaaaccaaacctaaccctaccgtacccgtacccgtacccgtaccgtacttacctccgagtccccgtcccccttccgggtcggtaacgaactcgtaccctaccggtcctacgtccggttgtcgtggtcgtacgtaccgtacggtaccggtacggacgggacgtacggtacgtacgtacgtacgtactacgtaccgttacgttcgttcgttgtcgtcgtcgtcgtcgtacgtcggtacggacggtacggacgtaacgtacgttacgtacgttacgtacgtaccgacgccgttacgtcccgtccgtcccgtccgtccttccgttcccgttcccgtcccg

SEQ ID NO: 359012 - DNA, 541 bp, Homo sapiens
  misc_feature: GZ8MTXP01D15AJ.17.33.C11.1.454.CMB.2.raw
  modified_base (175)..(175): a, c, t, g, unknown or other
  misc_feature (175)..(175): n is a, c, g, or t
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
  modified_base (505)..(505): a, c, t, g, unknown or other
  misc_feature (505)..(505): n is a, c, g, or t
  modified_base (512)..(512): a, c, t, g, unknown or other
  misc_feature (512)..(512): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccanacagaccctcacgctgacctgcaccttctctggcttctcactcagaacgagtggaatgggagtgggctggatccgtcagcccccaggaaaggccctggagtggcttgcgctcatttatggatgagagtaagcactacagtccgtctctagaagaacaggcctaccaccatcaaccaaggaaccaccctcaacaaaccaggtcgtaccttacgaatgaccaatancggacctgtggacacagccanatattactgttcacgtctctagtggttcggattattacgtccctagtttgactacgtgggccagggtacttcgtggtcaccgttnttaccgnagccctacacgacggcccttaagtccccg

SEQ ID NO: 359013 - DNA, 621 bp, Homo sapiens
  misc_feature: GZ8MTXP01EWYZ7.17.33.C11.1.454.CMB.2.raw
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
  modified_base (342)..(342): a, c, t, g, unknown or other
  misc_feature (342)..(342): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactggttccagcaagaaccnggacaagcaccgaggcactcatttanagtaacaaacaaacaaacactcctcggaccccctgcccgtattcncgacgcctccccctccgttggggcaaagctcgccctgactactgtctcggtgtgcagcgtgaggacgagctagacttatactgcctactcttacgtttggggtggttgctgtgtcgttagttccgggacgggtacgggtaccgaacggtccgtacggtaacccgttcgttaaacggtccgaacggaccccgtaacgggttcccgttcccgttccccccgttcgggtccctaaccgttcccgttcccgttaccccctaaccccgttcccctttaaccccg

SEQ ID NO: 359014 - DNA, 578 bp, Homo sapiens
  misc_feature: GZ8MTXP01DA2VU.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcacgcccccaggaaacggccctggagtggcttgcgctctatttatgggatgagagtaagcactacagtccgtctctagaagaacaggctaccaccatacaaccaaaggaaccaaccctccaaacaaaccgagggtacggtacccttaacaatacgaacctaatatcggaccctgtacggaacacagaccacatacttactgttacacgtctactagtgggttcgggtatttacgttacgtcccttattcgacgtcgtggggccaggggtacttcgtcggtcaccgttcttccgcacgccctaccgacgaacggcccaagttccccg

SEQ ID NO: 359015 - DNA, 660 bp, Homo sapiens
  misc_feature: GZ8MTXP01DHP6B.17.33.C11.1.454.CMB.2.raw
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
  modified_base (299)..(299): a, c, t, g, unknown or other
  misc_feature (299)..(299): n is a, c, g, or t
  modified_base (345)..(345): a, c, t, g, unknown or other
  misc_feature (345)..(345): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcacctgtncttaccaacactgagcaagtcaccagtntcttactatccaaatggttccagcaagaaacctggacaagcaccaggcactcatttaanagtaacaaacaaacaaacactcctacggaccccctgcccgattccncacggcctacccccctccgttagggggcaaacgctcgccctgactactgtcctggtgtcgcagcctaggacggacgagggctaggtaacttagttaactcgtaccttactctttacgttttgggggtggttcgtcttgtcgtcttaaggtttccgggaacgggagggtaaccaaaggtccgttcggtaacccgtttcgttaaacgggtccaacggtacccgaaacggggttccccgccccggttacccccgttccggtacccgtaacccgttcccgttaccccgttaccccctaaccccgtttcccgttaacccg

SEQ ID NO: 359016 - DNA, 790 bp, Homo sapiens
  misc_feature: GZ8MTXP01C6KQN.17.33.C11.1.454.CMB.2.raw
  modified_base (187)..(187): a, c, t, g, unknown or other
  misc_feature (187)..(187): n is a, c, g, or t
  modified_base (228)..(228): a, c, t, g, unknown or other
  misc_feature (228)..(228): n is a, c, g, or t
  modified_base (294)..(294): a, c, t, g, unknown or other
  misc_feature (294)..(294): n is a, c, g, or t
  modified_base (342)..(342): a, c, t, g, unknown or other
  misc_feature (342)..(342): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagacccctnacgctgacctgctaccttctctggcttctcactcagaacgngtggaagtgggagtgggctggactccggcacgccccgaggaacgcctggagtcggcttagcgtctntagtttagtggatgaagtagtacgctaacgtacgacggttcccgttanccgttagaaacgaacgtagggtcctaccacccgtaacttaccgaaacccgtaaacgggaaacccctaccgtaacccgtaaacgtaaaacccgtagggttaccggttacccttaaacgaacgttacggtaaccctaaagttacgttacgggaccccgttaggttacggaacctaccgaacgtccctaaacgttacgttaacgtttaccgttacggttaccgtaccggttacgtttccgttaaaggttcgggggtttaaccgggtaacgtttttacgttaaaccgttccccgttaaagtttcgaaacccgtttacggtaacggggtcccttaaacgggggtacctttacgtaccggggttaccttaaccccgggttccacccggtaacgttacccgtaacccgttaccccgaaccgggttaccggggtcccctttaaggtttcccccggg

SEQ ID NO: 359017 - DNA, 533 bp, Homo sapiens
  misc_feature: GZ8MTXP01CY9YE.17.33.C11.1.454.CMB.2.raw
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
  modified_base (366)..(366): a, c, t, g, unknown or other
  misc_feature (366)..(366): n is a, c, g, or t
  modified_base (380)..(380): a, c, t, g, unknown or other
  misc_feature (380)..(380): n is a, c, g, or t
  modified_base (402)..(402): a, c, t, g, unknown or other
  misc_feature (402)..(402): n is a, c, g, or t
  modified_base (464)..(464): a, c, t, g, unknown or other
  misc_feature (464)..(464): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgaccctgccaccttctctggcttctcactcagaacgagtggaatgggagtgggctggatccgtcagcccccaggaagcctggagtgcttgctctcatttatggatgagagtaagcactacagtccgtntctagaagaacngctccacatcaccaagacactcacaacagtgcctanaatcgacaatacgngaccctgtacgacacagcccanatattactcgttacacgtctctagttcggttcggggatttagtacgtcctacgtttgactgngggtccagggacttcgtggtccacggttcttccggcacgccctcgaccgttacggcccttaagtccccg

SEQ ID NO: 359018 - DNA, 615 bp, Homo sapiens
  misc_feature: GZ8MTXP01BFTL3.17.33.C11.1.454.CMB.2.raw
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactcgcacgcccaggaacgccngagngctgcgntcattagtggatgagagtaagcactacagtccgtctctagaagacaggctaccaccatacaacccaagaaccacctccaaccaaaccgacggtacgtaccttaacaaactacaaccctaaagtacgtacggacccttgacggaaccacgacgacccaacattaacgttaacttcggttacaacgtcttccgttaaggttgggtttacggggtagtttaacttaacggttcccttacgtttacgtaccgttacggtcggggaccgaggggtaaccttcgtacggttccacccgttcgccgcacgccctacccgacgaccgggcccttcgttcccccgg

SEQ ID NO: 359019 - DNA, 550 bp, Homo sapiens
  misc_feature: GZ8MTXP01BR1KY.17.33.C11.1.454.CMB.2.raw
  modified_base (238)..(238): a, c, t, g, unknown or other
  misc_feature (238)..(238): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
  modified_base (275)..(276): a, c, t, g, unknown or other
  misc_feature (275)..(276): n is a, c, g, or t
  modified_base (278)..(280): a, c, t, g, unknown or other
  misc_feature (278)..(280): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (287)..(288): a, c, t, g, unknown or other
  misc_feature (287)..(288): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (294)..(295): a, c, t, g, unknown or other
  misc_feature (294)..(295): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (302)..(303): a, c, t, g, unknown or other
  misc_feature (302)..(303): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (309)..(310): a, c, t, g, unknown or other
  misc_feature (309)..(310): n is a, c, g, or t
  modified_base (312)..(312): a, c, t, g, unknown or other
  misc_feature (312)..(312): n is a, c, g, or t
  modified_base (317)..(317): a, c, t, g, unknown or other
  misc_feature (317)..(317): n is a, c, g, or t
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagngggctggactacggcagccctaggaagccgngngngnngnnntntntgnnananannanantcnnanananncncacanacacacaacacncacacgacgtacgtactacanacacatagacgacgtgacgacacacacactactactacttcgtacgtacgtacgtacgttacgttacggttacgggttacgttacgttacgttaccgttacgttacgtacgtcggtcggtacggttacggtacgttcgtcgtccgttccgttccgttccgaaccgccgtccgtaccgaccgaccggtccgttccgtcccg

SEQ ID NO: 359020 - DNA, 632 bp, Homo sapiens
  misc_feature: GZ8MTXP01C2DQV.17.33.C11.1.454.CMB.2.raw
  modified_base (441)..(441): a, c, t, g, unknown or other
  misc_feature (441)..(441): n is a, c, g, or t
  modified_base (587)..(587): a, c, t, g, unknown or other
  misc_feature (587)..(587): n is a, c, g, or t
  modified_base (594)..(594): a, c, t, g, unknown or other
  misc_feature (594)..(594): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacacgaccctcacgctgacctgccaccttctctggcttctcactcagaacgagtggaagtgggagtgggctggactccgcacggcccccgaggaacggccctggagtggcttgcgctctatttagtggatgagagtaagacactacacgtccgtctacgtagaagaacaggactacccaaccataccaaaccaaacggaacccaaccctaacccaaacaaaccgtacggtacggtacccttaacaaactacgaaacctaagtacncggtaccctagtacggaacacgacacccaatattacttactgttacacgtctacgtagttgggttacgggtaatttagttaccgtaccgtttacgttacgtaaccgtacggttcggggacccttaggggtaacttcgtcggtaccnccgttcnccgcactcccaccgacgacggcccttaacgttccccgg

SEQ ID NO: 359021 - DNA, 575 bp, Homo sapiens
  misc_feature: GZ8MTXP01AYOX9.17.33.C11.1.454.CMB.2.raw
  modified_base (471)..(471): a, c, t, g, unknown or other
  misc_feature (471)..(471): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaacggccctggacgtggcttgcgctcatttatgggatgagagtaagcactacagtccgtctctgaagaacaggctccaccatccaaccaaggaacaccctccaacaaacccgaggtcgtaccttacgaactcgaaccaatactcggaccctgtggaaccacacgccaacactattactgttcaacgtctactagtggttcgggattnttaacgtccttactttgacttacgtggggcccagggtaaccttcgtcgggtccaccggttcttccggcacgccctccaccgttaacgggcccttaagtccccgg

SEQ ID NO: 359022 - DNA, 602 bp, Homo sapiens
  misc_feature: GZ8MTXP01CCHWS.17.33.C11.1.454.CMB.2.raw
  modified_base (175)..(175): a, c, t, g, unknown or other
  misc_feature (175)..(175): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccanacagaccctcacgctgacctgcaccttctctggcttctcactcagaacgagtggaatggggagtgggctggatccgtcacgccccaggaaggccctggagtggcttgcgctcatttattgggatgagagtaagcactacagtccgtctcgtagaaacgaacaggctacccaccatccaaaccgaacggaaccaaccctcccgaaacaaacccgagggtacggtaccttaacaatcgaaccaatactcggaccctgacggaacacacgccaacattacttacttcgttacacgtcttacgtagttgggttacggtagtttatacgttcctatttacgacttaaggtcggggacgaggtacttcgtcgggtcttaccggttcttccgccgacgtccctaccgacccgacgggtccccttgttccccggg

SEQ ID NO: 359023 - DNA, 736 bp, Homo sapiens
  misc_feature: GZ8MTXP01DGZJF.17.33.C11.1.454.CMB.2.raw
  modified_base (218)..(218): a, c, t, g, unknown or other
  misc_feature (218)..(218): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactnagaacgagtggaagtgggagtgggctggactccgtacacgccccgaggaacggccctggagtggcttgcgctctagtttagtggatgagagtaagcactacgacgtccgtctcgtagaacgaacgaggacctaccgaccataccaaccaacggaacccaaccctaacccaaacgaaaccgtacgggtacggtaccttaacaacgtacgaacctaagtacgtacgggaccctggtacggaactacgacaccaatattaacttacgttcgttaccggtacgtccgtttacgttacggttacggggtttacggggtaacttttaagtttaacccgtttccccgtttaacgtttcggaaccgtttaccgggtaacgggggtaccccgttaaagggggttaacccttcggtttaccggggtcccttaaccccgggttcccttaccccggtaacgtaacccggtcccccttaaccccggaacccggttaaaccgggggtcccccttaacggtttcccccccggg

SEQ ID NO: 359024 - DNA, 611 bp, Homo sapiens
  misc_feature: GZ8MTXP01EBCTR.17.33.C11.1.454.CMB.2.raw
  modified_base (272)..(272): a, c, t, g, unknown or other
  misc_feature (272)..(272): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcagaaaccnggacaagcaccaggcactcatttatataacaaacaacaaacactcctcggacccctgccgattcctcacggcctccccctcgttacggggacaaacgctcgccctgacactgtctggtgtgcagctggaggacgaggctagtacttactactgcctacttcgttacgtttgggggtggttgtctggtcgtgttacggttcgggacgggtaacgggaccgaaagtccgtaggtaaccgttacttaaggtccaacggacccgtaacggggccttcccggacccccgttcgggtccctaaccgttccgttaccgttcccctaaccccgttccctttaacccg

SEQ ID NO: 359025 - DNA, 644 bp, Homo sapiens
  misc_feature: GZ8MTXP01BDH4D.17.33.C11.1.454.CMB.2.raw
  modified_base (148)..(148): a, c, t, g, unknown or other
  misc_feature (148)..(148): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggngtcttgtcctacgctggtgaaacccacacagaccctcacgctgacctgcaccttctctggcttctcactcagaacgagtggaatggggagtgggctggatccgcacgccccaggaaggccctggagtggcttgcgctcatttagttgggatgagagtaagcactacacgtccgtctcgtagaagaacaggtctacccaccataccgaaccaaacggaaacccaccctaacccaaaccgaaaacccgtacgggttacggttacccttaaacaaacgttacgaaccctaaattacgtacgggtaaccccgtaggtacggaacacgacgacccaacaattacttacttcgttacacgtcttacgtagttgggttacgggtagttacttacgtcccttattcgactacggtcggggccgttaagggtacttcgtcggtccttacccgttcacccgcgacgtcccgtccccaacggaacgggtccccttaagttcccccgg

SEQ ID NO: 359026 - DNA, 623 bp, Homo sapiens
  misc_feature: GZ8MTXP01D183O.17.33.C11.1.454.CMB.2.raw
  modified_base (272)..(272): a, c, t, g, unknown or other
  misc_feature (272)..(272): n is a, c, g, or t
  modified_base (440)..(440): a, c, t, g, unknown or other
  misc_feature (440)..(440): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactggtccagcaagaaaccnggacaagcaccaggcactcatttatagtacaaaacaacaaacactcctcggacccctcgacccgattcctacacggcctccccccgtccgtttcgggggacaaacgcctacgccctgaccacgtcgtctggtgtgcacgcgtgaggacgaggctagtacttattaccncgtacccttacttacgttaccgtttgggggtggttgtcgttgtcgtcgttagttcggggacgggacgggtaaccgaacggtccgtcggaaccgttacgttaacgtcgaacgcccgaacggccgttccgcccccgttcggtcctaaccgttcgtcccgttccccgtccccttcccgttaacccg

SEQ ID NO: 359027 - DNA, 652 bp, Homo sapiens
  misc_feature: GZ8MTXP01C460U.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtcgaaacccacacagaccctcacgctgacctgccaccttctctggcttctcactcagaacgagtggaatggggagtgggctggactccgtacacgcccccgaaggaaacggccctggagtggcttgcgctctagtttagttggatgagagtaagcactacgagtcccgtctacgtagaagaacacggctaccaccataccaaccgaacgaaccaccctaaccaaaccaaaccgtacggtacgtaccttaacaatacgaacctaatacgacggaaccctggtacgaacacacgaccaactattaacttactcgttacaccggttcttacgtaaggttcgggttacggggtaatttacgttaccgttcccttagtttacgaaccgttacggtcgggggtaccaggggtaaaccttcgttacggtacccttaccggttcttcccggcaccgtccgtaccccacggttaaccggcccttaacggttccccg

SEQ ID NO: 359028 - DNA, 653 bp, Homo sapiens
  misc_feature: GZ8MTXP01CDU57.17.33.C11.1.454.CMB.2.raw
  modified_base (336)..(336): a, c, t, g, unknown or other
  misc_feature (336)..(336): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccgaggaacggccctggagtggcttgcgctctatttagttggatgagagtagcactacagtccgtctctagaagaacnggctacccaccataccaacccaaacggaacccaccctccaaacaaacccgacgggtacgtaccttaacaatacgaaccctaaattacgtacgggaacccctggtacggaaccacgaacgcccaactaattaacttaccttcgtttaccgacgtcttaccgtaagttcggggttaccggggtatttacgtttacgttccccttagtttacggaccgttaacggtcggggaccgttaggggtaaccttcgtacgggtccttacccgttccttcccgctaccgcccgtcccgacccgaacgggtccccaagttccccggg

SEQ ID NO: 359029 - DNA, 550 bp, Homo sapiens
  misc_feature: GZ8MTXP01DHPKM.17.33.C11.1.454.CMB.2.raw
  modified_base (483)..(483): a, c, t, g, unknown or other
  misc_feature (483)..(483): n is a, c, g, or t
  modified_base (507)..(507): a, c, t, g, unknown or other
  misc_feature (507)..(507): n is a, c, g, or t
  modified_base (519)..(519): a, c, t, g, unknown or other
  misc_feature (519)..(519): n is a, c, g, or t
tcagcgtagactagcacgaccggtgctcgatttagagtgagctcgttgggtttgggggactcctgtgccccaccatggacacactttgctccacgctcctgcttctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttagtgggatgagagtaagcactacagtccgtctctgaagaacaggctcaccccatcaccaacgacaaccctccaacaaaccaggtcgtacctacaatcgaccaatatcggaccctgtacggacacagccaacatatactgttcacggtctctagtcgggttcgggtattagttagtcccttatttgactacgnggggtccaggggactcgttggtcnccgttcttcgcngccctcaccgaggccctaagttccggttccc

SEQ ID NO: 359030 - DNA, 652 bp, Homo sapiens
  misc_feature: GZ8MTXP01D8O2W.17.33.C11.1.454.CMB.2.raw
  modified_base (280)..(280): a, c, t, g, unknown or other
  misc_feature (280)..(280): n is a, c, g, or t
  modified_base (310)..(310): a, c, t, g, unknown or other
  misc_feature (310)..(310): n is a, c, g, or t
  modified_base (362)..(362): a, c, t, g, unknown or other
  misc_feature (362)..(362): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttccaacactggagcagtcaccagtgcttactatacctaaactcggttaccagacaacgaaaccgnggaacaacgcaccgaggccactctatttanaagtaacaaaacaaacaaaaccactacctacggacccctgacccgtattccncgacgcctcccccgtcgttcggggacaacgctacgccctgacactgtcgtggtgtgcgacgcgtaggacggacgacggtctagtaacttaacgttacgtcgtacccttacgttacgtttacgtttcgggggtggttcgtcgttgtcgtacgttacgttcggggacggacggaccgtaagtccgtcgtaaccgttacgttaacgtccgttaccgacccgtaacggttccgttcccgttccccgtcggtcctaaccgttccgtccggttcccctccccttccgtttaacccg

SEQ ID NO: 359031 - DNA, 500 bp, Homo sapiens
  misc_feature: GZ8MTXP01CP415.17.33.C11.1.454.CMB.2.raw
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (372)..(373): a, c, t, g, unknown or other
  misc_feature (372)..(373): n is a, c, g, or t
  modified_base (377)..(377): a, c, t, g, unknown or other
  misc_feature (377)..(377): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (385)..(385): a, c, t, g, unknown or other
  misc_feature (385)..(385): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggatgggctggatccgtcagccccaggaaaggccctggagtggcttgcgctcatttattgggatgagagtaaagcactacagtccgtctctgaagaacaggctcaccatcacaagacactcanaaacagngtctacaannacanangacngnganacancacatatatntcgacnctctatggtgggtagttattacgtcctacttntactntcggcgaggacgttcgtcgtcacgcttccgcncgccnccaccacgaaccgcgtcg

SEQ ID NO: 359032 - DNA, 658 bp, Homo sapiens
  misc_feature: GZ8MTXP01AXVOB.17.33.C11.1.454.CMB.2.raw
  modified_base (621)..(621): a, c, t, g, unknown or other
  misc_feature (621)..(621): n is a, c, g, or t
  modified_base (650)..(650): a, c, t, g, unknown or other
  misc_feature (650)..(650): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaaaggccctggagtggcttgcgctcatttagtgggatgagagtaagcactacagtccgtctcgtagaagaacaggcctaccaaccataccaaacccgaaacggaaaccctaccctaacccaaaccgaaaacccgtacgggtacggttacccttaacaaacttacgaaacccctaaagtacttacgggaccccgttaggtacggaaccaaccgtacgacccctaagtacttaacgtttactcgtttaccaacggtcttcgtaagttggggttacggggtatttacgtttacgtcccttaacgtttgaccgttaacgtcgggggtaacccgttaggggtaaccttcgtcggtcaccgttcnccgcacgccctaccaccgacggggtcccngttccccg

SEQ ID NO: 359033 - DNA, 525 bp, Homo sapiens
  misc_feature: GZ8MTXP01AX6WP.17.33.C11.1.454.CMB.2.raw
  modified_base (225)..(225): a, c, t, g, unknown or other
  misc_feature (225)..(225): n is a, c, g, or t
  modified_base (266)..(266): a, c, t, g, unknown or other
  misc_feature (266)..(266): n is a, c, g, or t
  modified_base (332)..(332): a, c, t, g, unknown or other
  misc_feature (332)..(332): n is a, c, g, or t
  modified_base (389)..(389): a, c, t, g, unknown or other
  misc_feature (389)..(389): n is a, c, g, or t
  modified_base (414)..(414): a, c, t, g, unknown or other
  misc_feature (414)..(414): n is a, c, g, or t
  modified_base (472)..(472): a, c, t, g, unknown or other
  misc_feature (472)..(472): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggancagtcaccagtgcttacatccaaactgttccagcagaaacnggacagcaccaggcactcatttatagtacaaacaacaaacactcctcggacccctgcccgattccncacggctcccccctccgttgggggcaaagctcgccctcgacactgtcgtggtgtgcngcctgaggacgagctgactattacngcctactcttactttggggtgtgtctgtgtctagtcggcggaggacagctgaaccgtnttagtcagtccgaagccgttcgcccctcgctctctcgttccctcgttcctccg

SEQ ID NO: 359034 - DNA, 521 bp, Homo sapiens
  misc_feature: GZ8MTXP01AJKFL.17.33.C11.1.454.CMB.2.raw
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (274)..(279): a, c, t, g, unknown or other
  misc_feature (274)..(279): n is a, c, g, or t
  modified_base (284)..(286): a, c, t, g, unknown or other
  misc_feature (284)..(286): n is a, c, g, or t
  modified_base (291)..(292): a, c, t, g, unknown or other
  misc_feature (291)..(292): n is a, c, g, or t
  modified_base (294)..(296): a, c, t, g, unknown or other
  misc_feature (294)..(296): n is a, c, g, or t
  modified_base (298)..(300): a, c, t, g, unknown or other
  misc_feature (298)..(300): n is a, c, g, or t
  modified_base (302)..(302): a, c, t, g, unknown or other
  misc_feature (302)..(302): n is a, c, g, or t
  modified_base (304)..(305): a, c, t, g, unknown or other
  misc_feature (304)..(305): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (312)..(312): a, c, t, g, unknown or other
  misc_feature (312)..(312): n is a, c, g, or t
  modified_base (322)..(322): a, c, t, g, unknown or other
  misc_feature (322)..(322): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtgggagcgggctgggactacggcgacgacgagancngngngnnnnnntgtgnnngagannannncnnnananncncanancacacacacncacacagngtactacanacacanancgacgtacgacgacacacacactactactactcgtacgcgtctcgtcgtaggttcggtacgttacgttacttcgttcgttacgtacgtacggtcggtacgttacgtacgttcgtcgtccgttaccgttccgttccgaaccgccgccgcccgaccgaccgtaaccgttccgtccg

SEQ ID NO: 359035 - DNA, 601 bp, Homo sapiens
  misc_feature: GZ8MTXP01A7I8R.17.33.C11.1.454.CMB.2.raw
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaaaccnggaacaagcacccaggcactcatttanagtaacaaacaacaaacactcctacggacccctgcccgattcctcacggcctccccctccgttgggggacaaagctacgccctgacactgtcgtggtgtgcagccgtggaggacgagctagtactattactgcctactcttacgtttggggtggtgcgtgtgtcgtagttcgggcgggtacggaccgaagtccgtggtaacccgttacgttaaagtccgacgacccgtaacggttcccgttccggttcccccgtccgggtacctccgttcctccgttaccccctccccttcccgttaacccg

SEQ ID NO: 359036 - DNA, 585 bp, Homo sapiens
  misc_feature: GZ8MTXP01A1TUL.17.33.C11.1.454.CMB.2.raw
  modified_base (185)..(185): a, c, t, g, unknown or other
  misc_feature (185)..(185): n is a, c, g, or t
  modified_base (225)..(225): a, c, t, g, unknown or other
  misc_feature (225)..(225): n is a, c, g, or t
  modified_base (348)..(348): a, c, t, g, unknown or other
  misc_feature (348)..(348): n is a, c, g, or t
  modified_base (379)..(379): a, c, t, g, unknown or other
  misc_feature (379)..(379): n is a, c, g, or t
  modified_base (565)..(565): a, c, t, g, unknown or other
  misc_feature (565)..(565): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctnacgctgacctgcaccttctctggcttctcactcagaacgngtggaatggggagtgggctggactccggtcacgccccaggaagcctggagtggcttgcgctcatttatggatgagagtaagcactacagtccgtctacgtagaagaacacggctccaacctanacaaccgaaggaaccacctcaacaaacccgnggtcgtacttaacaaagtcgaaaccaattacgaccgggtaccctaggtacgggaacacgagacccaaatattacttactcgtacgacgtcttacgtaggttggttacgggtatttagtaccgttccttagttcgaacgtcgggaacgggtcgaggtcttcgtcgtccgccgttcaccgccacgccnccaccgaccgtccgcgtccg

SEQ ID NO: 359037 - DNA, 648 bp, Homo sapiens
  misc_feature: GZ8MTXP01EL7SH.17.33.C11.1.454.CMB.2.raw
  modified_base (281)..(281): a, c, t, g, unknown or other
  misc_feature (281)..(281): n is a, c, g, or t
  modified_base (336)..(336): a, c, t, g, unknown or other
  misc_feature (336)..(336): n is a, c, g, or t
tcagcgtagactagcacgaccggtgctcgatttagagtgagctcgttggggtttgggggactcctgtgccccaccatggacacactttgctccacgctcctgctgctgaccatcccttcatgggtcttgtcccagatcaccttgaaggagtctggtcctacgctgatagaaacccacacagaccctcacgctgacctgcaccttctctggcttctcactcagaacgagtggaagtggggagtggggctgggactccgtcacgccccgaggaaacggcccgnggagtggcttgcgctctatttagtgggatgagagtaagcactacacgtccgtctntagaagaacacggcctacacataccaaccaaaacgaccaaccctaccaaaccaaaccgacggtacggtacccttaaacaaacgtacgaaccctaaagtacgttacggaccccttggtacggacaacacaccacaattacgttactggttacacgtctacgttagtgggttacgggtagtttaacttcgttcccttacgtttcgaagtaaccggtacggggccgtaacggggttaactcgtcgggttccaccggttcctaaccggccaaccggtccctacccgaaccggtaaccggggttcccttaacccggg

SEQ ID NO: 359038 - DNA, 713 bp, Homo sapiens
  misc_feature: GZ8MTXP01DD2D7.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcctaccttctctggcttctcactcagaacgagtggaagtggggagtgggctggactccgcacgccccgaggaacggcctggagtggcttgcgctctagttagtggatgagagtaagcactacacgtcctctacgtagaacgaacgacgctacccaccataccaaaccgaacgaacccaacctaacccaaacgaaaccgtagggttacgtaccttaacgaaatacgaaacctaagtacgtacggtacccgtggtaacggaaccacgaacgaccctaaataactttaacttaacgttcgttaccggtaacgttcgtttacgttacggggttacgggggtttaccggggttaatttttacgtttaaaccgttccccgtttaagtttacggaaccgttacgggtaaccggggtaacgttaacgggtaccgttcgttacgggttcccttaccgttccgttacccgaaccgtacctcccgtaacccgaaccggaacggtccccgttaacgttcccccggg

SEQ ID NO: 359039 - DNA, 739 bp, Homo sapiens
  misc_feature: GZ8MTXP01A35NM.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgccaccttctctggcttctcactcaagaacgagtggaatggggagtgggctggactccgcacgaccccgaaggaacgccctggagtggcttgcgctctagtttagtgggatgagagtaagctactacgacgtcccgtctacgtagaaacgaacgacggctacccaccactaccaaaccgaaacggaaacccaaccctaacccaaacaaacccgtacgggttacgtacccttaaacaaacttacgaaccctaaagtacgtacgggaccctaggtacggaaccacacgaccaaactacttaactttaacgttcgttaccgtaacggtcctttaacgttacgggtttcgggggttaccggggttaattttaacgtttaaccggttcccctttaacgtttcggtaaccgtacggggttaacgggggtacccgttaaagggggttaacccttcggttacggtacccgttaacccggttccttaccccggcgtacccggtccccttacccgaacccggaaccgggtccccttaacggtttcccccggg

SEQ ID NO: 359040 - DNA, 632 bp, Homo sapiens
  misc_feature: GZ8MTXP01BJK7A.17.33.C11.1.454.CMB.2.raw
  modified_base (229)..(229): a, c, t, g, unknown or other
  misc_feature (229)..(229): n is a, c, g, or t
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
  modified_base (344)..(344): a, c, t, g, unknown or other
  misc_feature (344)..(344): n is a, c, g, or t
  modified_base (397)..(397): a, c, t, g, unknown or other
  misc_feature (397)..(397): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccgaggaggacagtcactctcacctgtcgcttaccaacactggancagtcacagtgcttactactacaaatggtacagcaagaacnggacagccaccgaggcactctatttaanaagtaacaaacaaacaaacactccgtacgacccctcgcctattccncgacgcctaccccgtcggtaggggacaaagctacgccctgactactgtctggngtcgcacgccgtggacggacgagctagtacttatacgtcgaccttctcgtttacgttgggggtgtgtcgtgtcgtacgttagttccgggacggtacgggaaccctaggtccgtacggtaaccgtttcgttaaacggtccgaaccggtacccgtaacggcccgttacccggccccccgttcggtacccttaaccgttccccgtcccgttaaccccctcccctttcccgttaacccg

SEQ ID NO: 359041 - DNA, 656 bp, Homo sapiens
  misc_feature: GZ8MTXP01A20VR.17.33.C11.1.454.CMB.2.raw
  modified_base (300)..(300): a, c, t, g, unknown or other
  misc_feature (300)..(300): n is a, c, g, or t
tcagcgtagactagcacgaccggtgctcgatttagagtgagctcgttgggtttggggggcgccaggggtcccttccaatatcagcaccatggcctggacccctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaaacctggacaagccacccgaggcactcatttanagtaacaaacaacaaaccactcctacggacccctcgacccgtattctcacggtcctccccgtcccggttagggggacaaacgtcctcggaccccctgaacctacgttgtccgttggggtcgtaggcaacggtcgtaggacgggaacgacgggcttacgaacgtttattacctcggtccttaacgtctttacgtttgggttcggggttgtccgttggtcgtacgttagttcgggacgggtacgggaccaagtcgtacggtccgttcttaagttccgacgttacccgaacggtccgttcccgccccgttcggtccctaccgttcgttcccgtcccgttccccttccgttccgtaaccg

SEQ ID NO: 359042 - DNA, 655 bp, Homo sapiens
  misc_feature: GZ8MTXP01D2LKK.17.33.C11.1.454.CMB.2.raw
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
  modified_base (349)..(349): a, c, t, g, unknown or other
  misc_feature (349)..(349): n is a, c, g, or t
  modified_base (613)..(613): a, c, t, g, unknown or other
  misc_feature (613)..(613): n is a, c, g, or t
  modified_base (620)..(620): a, c, t, g, unknown or other
  misc_feature (620)..(620): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgctaccttctctggcttctcactcaagaacgagtggaagtggggagtgggctggatccgtcgacgcccccgaaggaaacggccctggagtggcttgcgtctctatttagttgggatggagagtagcactacngtcccgtntcgtagaagaacnggcctccaccataccaaccaacgaacccaccctccaaaccaaaccgtacgggttacggtacccttaacgaaattacgaaccctaagttacgtcgggaacccgttggtacggaaaccacgaacgacccaaactaattaactttaacgtcgtttaccacggttccttacgtagttcggggttacgggtatttacgttacgttcccttagtttcgaccgttacggtcgggggaccgttagggtaaccttcggtcggtccaccgttcnccgaacncgccctaccgaccgaccgggtcccaagttccccgg

SEQ ID NO: 359043 - DNA, 588 bp, Homo sapiens
  misc_feature: GZ8MTXP01CF537.17.33.C11.1.454.CMB.2.raw
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
  modified_base (555)..(555): a, c, t, g, unknown or other
  misc_feature (555)..(555): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcctaccttctctggcttctcactcaagaacgaggtggaagtggggagtgggctggactccgcacgccccgaaggaacggcctggagtggcttgcgctctattgtggatgagagtagcactacagtccgtcncgtagaagacngctaccacanacaacaagaaccaccncaacaaacgtggtacgtacctaagatacaactatacgtacgccgtagacgaacacgacaccaactattacttacgtcttacgtacgtcttagttaggtcggttacgggtatttacgtttaccgtcccttagttcgtacgtacggtcgggaccgagggtacttcgtacggccttaccgttcgttccgcncgtcccgacgaccgacggtcccaacgttccccg

SEQ ID NO: 359044 - DNA, 614 bp, Homo sapiens
  misc_feature: GZ8MTXP01DYAY6.17.33.C11.1.454.CMB.2.raw
  modified_base (222)..(222): a, c, t, g, unknown or other
  misc_feature (222)..(222): n is a, c, g, or t
  modified_base (272)..(272): a, c, t, g, unknown or other
  misc_feature (272)..(272): n is a, c, g, or t
  modified_base (438)..(438): a, c, t, g, unknown or other
  misc_feature (438)..(438): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacnctggagcagtcaccagtgcttactatccaaatggttccagcaagaaaccnggacaagcaccgaggcactcatttaatagtaacaaacaacaaacactcctacggaccccctgcccgtattcctcgacggcctccccccgtccgttgggggacaaacgcctcgccctgactactcgtcgtggtgtgcagctggaggacgaggctagacttattacgngtaccctaacttcttacgtttgggggtggttgtcgtgtgtcgttagttcgggaacgggtacggaccgtaagtccgtgtaaccgttcttaaggtccacgtaccccgtaaggcccgttccgttcccccgtcggtacctccgttccgtccggttccccctccccgttaacccgttcccg

SEQ ID NO: 359045 - DNA, 584 bp, Homo sapiens
  misc_feature: GZ8MTXP01EFVBQ.17.33.C11.1.454.CMB.2.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgccttccaacactggagcagtcaccagtgtcttactatccaaactggttccagcaagaaacctgacaagcaccagggcactcatttatagtacaaacaacaaacactcctcgacccctgcccgattctcacgctccccctcgttggggcaaagctcgccctgacactgtctggtgtgcacgccgtggaagcgaagggctagacttacttactcgtcctaacttcttacgtttgggggtggtgtcgttgtgtcgttagttcgggacgggtacggaccgtagtcgtcgaaccgttacgttacgtccgagacccgaagccgttccgttccccgtcggtcctccgtcctccgttccctaacccgttccttaacccg

SEQ ID NO: 359046 - DNA, 610 bp, Homo sapiens
  misc_feature: GZ8MTXP01ANBG0.17.33.C11.1.454.CMB.2.raw
  modified_base (221)..(221): a, c, t, g, unknown or other
  misc_feature (221)..(221): n is a, c, g, or t
  modified_base (271)..(271): a, c, t, g, unknown or other
  misc_feature (271)..(271): n is a, c, g, or t
  modified_base (295)..(295): a, c, t, g, unknown or other
  misc_feature (295)..(295): n is a, c, g, or t
  modified_base (500)..(500): a, c, t, g, unknown or other
  misc_feature (500)..(500): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacnctggagcagtcaccgagtgcttactatccaaactggttccagcagaaacnggacagcaccaggcactcatttanagtacaaacaacaaacactcctcggacccctgcccgtattctcaggcctccccctccgttgggggacaaagctcgccctgacactgtcgtggtgtgcagcctggaggacgagggctagacttattactcgaccttactcgttacgtttggggtggttgtcgtgtcgtcgttacgttcgggacgggacgggtacccaaaggtccgnggtaacccgttaacgttagtaccgacggacccgaaacgggccttccggcccccgttccgggtcctaacccgttccttcccggttccccctaaccccgttccccttccccg

SEQ ID NO: 359047 - DNA, 631 bp, Homo sapiens
  misc_feature: GZ8MTXP01A51J7.17.33.C11.1.454.CMB.2.raw
  modified_base (368)..(368): a, c, t, g, unknown or other
  misc_feature (368)..(368): n is a, c, g, or t
  modified_base (428)..(428): a, c, t, g, unknown or other
  misc_feature (428)..(428): n is a, c, g, or t
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
  modified_base (603)..(603): a, c, t, g, unknown or other
  misc_feature (603)..(603): n is a, c, g, or t
tcagcgtagactagcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggcaaccgtcgcccggccaacatacgccttcctcccgtccccccttgcagtaacaccaagtacagaatacttaacctgtttcccatcgactacgccttcggcctcgccgttaggggtccactcaccctgcccctattaacgtggacacggaacccttggtccttccggngacgtccgggtctttcacccgtctttatcgttaccttatgtcagctaattcgctacttcngactacctcagcatcnctcacancctactacctcaacgacgtactaacgacgtaacccgccctaccccaaccaaaccgacgactaacgtacgtccgtccgccgtcgcccgcgcggtcgttcggcgtcgttacggttccggtttaacccgttccccgtttcactttccccgtcccncttacgtcgttacgtaaccttcggtccg

SEQ ID NO: 359048 - DNA, 575 bp, Homo sapiens
  misc_feature: GZ8MTXP01ELSMQ.17.33.C11.1.454.CMB.2.raw
  modified_base (239)..(239): a, c, t, g, unknown or other
  misc_feature (239)..(239): n is a, c, g, or t
  modified_base (267)..(267): a, c, t, g, unknown or other
  misc_feature (267)..(267): n is a, c, g, or t
  modified_base (292)..(292): a, c, t, g, unknown or other
  misc_feature (292)..(292): n is a, c, g, or t
  modified_base (333)..(333): a, c, t, g, unknown or other
  misc_feature (333)..(333): n is a, c, g, or t
  modified_base (413)..(413): a, c, t, g, unknown or other
  misc_feature (413)..(413): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtncttactatccaaatggtccagcagaacnggacaagcaccaggcactcatttanagtacaaacaacaaacactcctaggacccctgcccgattcncagcctccccctcgtggggactaagcctagccctgacactgtctggtgtgcagcctgacggacgaggctagacttattcngtcctactctacgtttggggtgtgtctgtgtctacgttcggacgggtacggacccaaagtcgtacggaaccgttcttaacgtcgacgacccgtaaggccgttccgcccccgtcgggtcctaacgttccgtccggttacccctaaccccgttccttaaccccg

SEQ ID NO: 359049 - DNA, 561 bp, Homo sapiens
  misc_feature: GZ8MTXP01B6VUU.17.33.C11.1.454.CMB.2.raw
  modified_base (295)..(295): a, c, t, g, unknown or other
  misc_feature (295)..(295): n is a, c, g, or t
  modified_base (449)..(449): a, c, t, g, unknown or other
  misc_feature (449)..(449): n is a, c, g, or t
tcagcgtagactagcacgaccggtgctcgatttagagtgagctcgttgggtttgggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtacaaacaacaaacactcctacggacccctgacccgattcctcaggcctccccctccgttgggggcaaacgctaacgccctggacacgtgtctggtgtcgcacgccgtgaggacgaggctagactattactgcctactcttacgtttggggnggtgtctgtgctagttcggacggaggtaccaacgtctggaaccgtcttacgtcacgacccaaggccgttcgcccctggtccaacgtctcgttccctaacccgttcctaaccg

SEQ ID NO: 359050 - DNA, 535 bp, Homo sapiens
  misc_feature: GZ8MTXP01BQCD6.17.33.C11.1.454.CMB.2.raw
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (424)..(424): a, c, t, g, unknown or other
  misc_feature (424)..(424): n is a, c, g, or t
  modified_base (513)..(513): a, c, t, g, unknown or other
  misc_feature (513)..(513): n is a, c, g, or t
  modified_base (525)..(525): a, c, t, g, unknown or other
  misc_feature (525)..(525): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttcccagcagaaaccnggacaagcacccagggcactcatttanagtaacaaacaacaaacactcctggacccctgcccgattcctcaggcctcccccctccgttgggggccaaaggctcgcccctgaccactgtctggtgtgcagcctgaggacgagctagactattacngtcctactcttacgttggggtggtgctgtgctagtcggcggaggaccaagctgcctcgttagtcagcccgaagccttcgcccctggtcnctctcgttcccnccttcctccg

SEQ ID NO: 359051 - DNA, 644 bp, Homo sapiens
  misc_feature: GZ8MTXP01DVPRI.17.33.C11.1.454.CMB.2.raw
  modified_base (304)..(304): a, c, t, g, unknown or other
  misc_feature (304)..(304): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttaccaacacgtggagcagtcaccagtgcttactatacctaaactggttccagcaagaaacctggacaagcaccgaggcaactctatttanaagtaacaaacaacaaacactacctacggacccctgcccgtattctacacggcctccccccgtccgttggggacaaacgctacgccctgacactgtctggtgtgcagcctaggacggacgaggtctacgtacttagttactcgtacctacttcgttaccgtttgggggtggttcgtccgttggttcgtacgttacggttcggggaccgggaacgggtaccgaaacggtccgtacggtaaccgttacgttaaacgtaccgacgtacccgtaacgccgttccgttcccccgtcgggtcctaaccgttcctcccgttacccctaacccttcccgttaaccccg

SEQ ID NO: 359052 - DNA, 579 bp, Homo sapiens
  misc_feature: GZ8MTXP01BE3IH.17.33.C11.1.454.CMB.2.raw
  modified_base (367)..(367): a, c, t, g, unknown or other
  misc_feature (367)..(367): n is a, c, g, or t
  modified_base (393)..(393): a, c, t, g, unknown or other
  misc_feature (393)..(393): n is a, c, g, or t
  modified_base (405)..(405): a, c, t, g, unknown or other
  misc_feature (405)..(405): n is a, c, g, or t
  modified_base (427)..(427): a, c, t, g, unknown or other
  misc_feature (427)..(427): n is a, c, g, or t
  modified_base (456)..(456): a, c, t, g, unknown or other
  misc_feature (456)..(456): n is a, c, g, or t
  modified_base (542)..(542): a, c, t, g, unknown or other
  misc_feature (542)..(542): n is a, c, g, or t
  modified_base (548)..(548): a, c, t, g, unknown or other
  misc_feature (548)..(548): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtggggagtggggctgggactaccggtccgacggacccccgaagggaacggccctgggagtggcttgcgtctcagtttagttgggatgagtagtaagcactactacgtccgtctctagaacgacgagctccactanaccacgacgaacacctccacaaacgngtcgtaccttanaatcgactatagtcggacctgngacagacgtccatatcgtactgtacccgntcttgtaggtggttacgtatttactaccgtcttagttacgacgtcgggtaaccggcgttacggtcttcggtcgtcccttccgttcnccgccncgccgaccgaccgaccgtccgttccgtcccg

SEQ ID NO: 359053 - DNA, 723 bp, Homo sapiens
  misc_feature: GZ8MTXP01EVSXS.17.33.C11.1.454.CMB.2.raw
  modified_base (216)..(216): a, c, t, g, unknown or other
  misc_feature (216)..(216): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcctaccttctctggcttcncactcagaacgagtggaagtggggagtgggctggactccgtcacgcccccgaggaacggccctggagtggcttgcgctctatttagtggatgaagagtaacgcaactacgtacgtcccgtctcgtagaaacgaacgacgctacccacactaccaaccaacggaacccaccctaaccaaaccgaaaccgtacgggtacgttaacccttaacgaaattacggaaacctaaagtacgtaccggtaaccccttgggtacggaaccaacgacgacccaatacttaacttaacgttcgttaccgtacgtcttacgttaggttcggggtttaccggggtaagttttacgtttaaccgtttcccctttaacgtttacgtaccgttacgggtcgggggtaacccgttaagggggttaaacccttcggttaccgggtcccttacccgggttccttcccggcctacccgtccccgtaacccgaacccggaccggggtaaccccttcggtttcccccgg

SEQ ID NO: 359054 - DNA, 666 bp, Homo sapiens
  misc_feature: GZ8MTXP01A4QL9.17.33.C11.1.454.CMB.2.raw
  modified_base (237)..(237): a, c, t, g, unknown or other
  misc_feature (237)..(237): n is a, c, g, or t
  modified_base (335)..(335): a, c, t, g, unknown or other
  misc_feature (335)..(335): n is a, c, g, or t
  modified_base (401)..(401): a, c, t, g, unknown or other
  misc_feature (401)..(401): n is a, c, g, or t
tcagcgtagactagcacgaccggtgctcgatttagagtgagctcgttgggttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtncttacatccaaactggttccagcagaaacctggacaagcacccagggcactcatttatagtacaaacaacaaacactcctcgacccctgcccgattcncagctccccctcgtggggcaaagctcgccctgaccactgtctggtgtgcgacgctaggaggacggnggctacgacttattactcgacccttactcttaccgtttgggggtggtcgtcgtggttcgtcgtacggttccggggacgggaccggggtaaccgaaacggtccgtacgggtaacccgtaactttaccgttaaaacggttccgtaaaccggtacccccggaaacgggttccccgttcccccggggtcccccccgttaaccggggtccctaaccccgttcccgtttaccccgggtttcccccccgttaaacccccgttttcccccccg

SEQ ID NO: 359055 - DNA, 561 bp, Homo sapiens
  misc_feature: GZ8MTXP01DV5J8.17.33.C11.1.454.CMB.2.raw
  modified_base (323)..(323): a, c, t, g, unknown or other
  misc_feature (323)..(323): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgtcacgcccccaggaaacggccctggagtggcttgcgctcatttatggatgagagtaagcactacagtccgtntctagaagaacaggctccaccatccaaccaaggaaccacctccaacaaaccgaggtcgtaccttacaatcgaaccaatatacggaccctgtaggacacacnccanatattactcgtacacgtcttactagtggttacggggtattattacgtcccttatttcgactacgtggggaccaggggtacttcgtacgtcacgttcttccgcagccctccacgaccgggcccaagttccccgg

SEQ ID NO: 359056 - DNA, 722 bp, Homo sapiens
  misc_feature: GZ8MTXP01AT7JV.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaaggccctggagtggcttgcgtctcatttatggatgagagtaagcactacagtccgtctctgaagaacaggctcccacataccaaccaaacggaaccaaccctccaaccaaaacccgagggtacggtccctttaacaaacttacgaaccctaaagtacgttacggaacccctggtacgggaaccaccaacggaccctaacaactttaacttaaccgttacggtttaccaaaccggtccttacgtttaaacgttcgggggtttacccgggggtaagttttaacggtttaaacggttccccttaacgttttacgaacccgttaaccggttcgggggacccgttaaacgggggtaaacccttcggttccgggtacccgttacccggttccgttccccgggaacctacggccccttaccccgaacccggttaaacggggcccccttaacgtttcccccgggg

SEQ ID NO: 359057 - DNA, 708 bp, Homo sapiens
  misc_feature: GZ8MTXP01BLA3K.17.33.C11.1.454.CMB.2.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccgaggagggacagtcactctcacctgtgcttccaacactggagcagtcaccagtgcttactataccaaactggttccagacaacgaaactggaacaagccacccgagggcactactatttataacgtaacaaaacaaacaaaccaacctcctcggaccccctcgcccgtacttctacgacggcctccccccgttccggttgggggaccaaagtccgtcgccctgacctacgtgtccgtggtcgtagcacgcgtaggacggacggaggcgtacgtaacttacgttactcgtacctacttaccgtttacgtttcggggggttgtcggtcgtggtcgtcgttacggtcgggacgggtacgggtaacctaacgggtccgttggtaaccccggtttagttaaacggttccgaccggtaccccggtaacgggttccccggttccccggttccccccgggttcccgttcccgtaacccgtttcccgttccccggttacccccgtaaccccctttccccgtttcccccgg

SEQ ID NO: 359058 - DNA, 740 bp, Homo sapiens
  misc_feature: GZ8MTXP01BWQF4.17.33.C11.1.454.CMB.2.raw
  modified_base (334)..(334): a, c, t, g, unknown or other
  misc_feature (334)..(334): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgctaccttctctggcttctcactcagaacgagtggaagtgggagtgggctggactccgtcacgccccgaggaacggccgtggagtggcgttgcgctctagtttagttggatggagagtagctactacgacgtccgtntacgtagaacgaacgacggctacccaccgactaccgaacccaaacggaacccaccctaacccaaccgaaaccgtacgggtaccgtaccttaacaaactacgaaccctaaagtacgtacgggaccctggtacggaaccacgacgccaactattacttacttcgttacgaaccggttcttaccgttagggtttacggggttacggggttaactttttacgtttacccggtttccctttaaacgtttacggtaacccgtttcggggtaacccgggggtaacccgttaaacgggggttaacccttcgggttacccggggtccttaaccccggttccgttccccgtaaccgacccgtaaccccttacccggaacccggttacccggtccccgttaaccgttttcccccggg

SEQ ID NO: 359059 - DNA, 660 bp, Homo sapiens
  misc_feature: GZ8MTXP01BWDVW.17.33.C11.1.454.CMB.2.raw
  modified_base (463)..(463): a, c, t, g, unknown or other
  misc_feature (463)..(463): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgcaccttctctggcttctcactcagaacgagtggaagtgggagtgggctggatccgtcacgaccccgaggaacggcctggagtggcttgcgctctagtttagttggatagagagtaagcaactacacgtccgtctcgtagaaagacaggcctacccaaccactcaaccgaacggaacccaaccctccaaacaaaccgtgggttacgtaccttaacgaatacgaacctaattacgcggaccctggtacggaaccacgacgacctaanattacttactcgttaccacgtcttacgtaggttcgggttaccgggtatttacgttaccgttcccttaagtttcgtaccgttacgggtcggggacccgttaaggggtaaccttcgtcgggtccttaaccgttcggttacccgtcccgacgaaccgtcccccgtacccgaccggtaaaccgggttccccttaacccggg

SEQ ID NO: 359060 - DNA, 785 bp, Homo sapiens
  misc_feature: GZ8MTXP01A0T4L.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtcgaaacccacacagaccctcacgctgacctgccaccttctctgcttctcactcagaacgagtggaagtgggagtgggctggactccgtcacgcccccgaggaacggcccgtggagtggcttgcgtctctatttagttgggatgagagtaagcactacacgtcccgtctacgtagaaagaacaggtcctaccaccatacccaaacccgaaacggaaacccaaccctaacccaaaccgaaaacccggagggttacggttaccctttaaacgaaactacgtaaaccctaaagttaacgtccgggtaaaccccgttggtaacggaaaccaccggacaccctaaactacttaacgttaaccttcgttaccgaacggtctttaccgtaaggtttcgggggttaccggggttaacgtttacgtttaacggttaccccgtttaacgtttacggtaacccggtttacgggtaaccggggggtcccgttaaacggggggttaaaccctttcgggttaccggggttaccccgttaaccccgggtttccgttccccggaacccgtaccgtccccgtaaccccgaaccccgggttaaacccggggtccccttaaccgggttttccccccggg

SEQ ID NO: 359061 - DNA, 654 bp, Homo sapiens
  misc_feature: GZ8MTXP01EOU2B.17.33.C11.1.454.CMB.2.raw
  modified_base (232)..(232): a, c, t, g, unknown or other
  misc_feature (232)..(232): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttaccaacactggancagtcaccagtgcttactataccaaactcggtacagcaagaaacctggaacaagccacccgaggcactactatttaataagtaaacaaaacaaacaaacctacctccctacggaccccctgaccccgtattctcgacgccttaccgtcggttacggggaccaaaagcctcgccctagaacctcgtcgtcgtgggtcgtgcgtacgccgtaggaacgggacggaggtacgtagtacttacttactcgtacccttacgttaccgtttagtttcggggtgttcgtcgttggtcgtcgttaacggttcgggacgggtaacggaccgtaggtctacgggttaccgttacgttaaagaccgacgacccgaacggttcccgtcccgtccccgtcgggttccaccgttccgtcccgtttccccgttcccc

SEQ ID NO: 359062 - DNA, 654 bp, Homo sapiens
  misc_feature: GZ8MTXP01DWUP1.17.33.C11.1.454.CMB.2.raw
  modified_base (317)..(317): a, c, t, g, unknown or other
  misc_feature (317)..(317): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtcccagggaggacagtcactctcacctgtcgcttaccaacacgtggagcagtcaccagtcgtacttactataactaaactggttaccagacaacgaaacctggaacaagccaacccgaggacactactatttaanaagtaacaaacaaacaaacactcctacgacccctgaccgtattctacgacgtcctccccctccgtaggggacaaacgctacgccctgactacgtgtcgtggtcgtcgacacgccgtaggacggacgaggtctacgtacttattaccgtcgaccttacttcgttacgtttgggggtgtcgtcttggtcgtcgtagttcgggacgggacggtaaccaaggtccgtcggtaaccgttcgttaacggtaccgacggaacccgtaacggttcccgttcccggttcccccgttcggcctaaccgttcccgtcccgttacccctaaccccgttcccttaacccg

SEQ ID NO: 359063 - DNA, 526 bp, Homo sapiens
  misc_feature: GZ8MTXP01BMAKV.17.33.C11.1.454.CMB.2.raw
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (409)..(409): a, c, t, g, unknown or other
  misc_feature (409)..(409): n is a, c, g, or t
  modified_base (488)..(488): a, c, t, g, unknown or other
  misc_feature (488)..(488): n is a, c, g, or t
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccgtcagccccaggaagccctggagtggcttgcgctcatttatgggatgagagtaagcactacagtccgtctctgaagacaggctccaccatcacaagaaccacctcacaaaccgngtcgtcctanaatcgaccaatatcggacctgtacgacacagccanatattactgttcacgtctctagtggttcgggtattattacgtcccttatttcgcgtacgtgggcagggacttcgtgtcnccgttcttccgccncgccnccaccgacgtccgcgtccg

SEQ ID NO: 359064 - DNA, 673 bp, Homo sapiens
  misc_feature: GZ8MTXP01C6Z34.17.33.C11.1.454.CMB.2.raw
  modified_base (327)..(327): a, c, t, g, unknown or other
  misc_feature (327)..(327): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctggcttctcactcagaacgagtggaatgggagtgggctggactccgtcacgccccgaaggaacggccctggagtggcttgcgctctattagtggatgagagtaagcactacacgtcccgtntcgtagaagaacaggcctaccaccactcaaccaacggaacccaccctaaccaaacaaacccgtacgggtacgtaccctaactaaactacgaaccctaatacgtacggaccctggtacggaacacacgaccaactattaattacttcgttacacgtcttacgttacggttgggtttacggggtaagtttacgtttaaccgtcccctttaagtttcgaccgttaccggtaacgggggtccgttaacggggtaaccttcgttacgggtcccttacccggttccttaccccggctaaccgtccccgtacccgaccggttaaccggggtccccttaacggtttcccccggg

SEQ ID NO: 359065 - DNA, 591 bp, Homo sapiens
  misc_feature: GZ8MTXP01C807T.17.33.C11.1.454.CMB.2.raw
  modified_base (225)..(225): a, c, t, g, unknown or other
  misc_feature (225)..(225): n is a, c, g, or t
  modified_base (267)..(267): a, c, t, g, unknown or other
  misc_feature (267)..(267): n is a, c, g, or t
  modified_base (295)..(295): a, c, t, g, unknown or other
  misc_feature (295)..(295): n is a, c, g, or t
  modified_base (341)..(341): a, c, t, g, unknown or other
  misc_feature (341)..(341): n is a, c, g, or t
  modified_base (560)..(560): a, c, t, g, unknown or other
  misc_feature (560)..(560): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggancagtcaccagtgcttactatccaaactggtccagcagaaccnggacaagccaccgaggcactcatttaanagtaacaaacaacaaacactacctcggacccctcgcccgtattccncgacggcctcccccgtccgttgggggcaaagcctacgcctgactacgtcgtcgtggtgtgcagcctggacggacgaggtctacggtacttaattacgtcgtaccttacttacgtttacgtttgggggtcggttgtcttggtagcgttagttcggacgggtaggaccaagtcgtcgtaaccgtcttagtcagacccgtaaggccttcgcccctcggtccncgttcctccgttcccgtcccgttccttcccg

SEQ ID NO: 359066 - DNA, 595 bp, Homo sapiens
  misc_feature: GZ8MTXP01C59HJ.17.33.C11.1.454.CMB.2.raw
  modified_base (339)..(339): a, c, t, g, unknown or other
  misc_feature (339)..(339): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcaagacgagtggaagtgggagtgggctggactccgtcacgcccccaggaacggccctggagtggcttgcgctctatttagttggatgagagtaagcactacacgtccgtctctagaagacnggcctccaccatcaacaacgaaccacctccaacaaaccgaggtcgtaccttacaaatcgaaccaatacgacggtaccctgtacggaacacagaccaactatattactgttcacgtctactagtgggttacggtatttacgtacgttccctatttcgacgttacgtcggggaccttaggggtaaacttcgtcgtccttacccgttcgttcccgcacgtccctacccgaccgttaacggtcccgttaacgttccccgg

SEQ ID NO: 359067 - DNA, 541 bp, Homo sapiens
  misc_feature: GZ8MTXP01DUIKQ.17.33.C11.1.454.CMB.2.raw
  modified_base (297)..(297): a, c, t, g, unknown or other
  misc_feature (297)..(297): n is a, c, g, or t
  modified_base (479)..(479): a, c, t, g, unknown or other
  misc_feature (479)..(479): n is a, c, g, or t
  modified_base (514)..(514): a, c, t, g, unknown or other
  misc_feature (514)..(514): n is a, c, g, or t
  modified_base (521)..(521): a, c, t, g, unknown or other
  misc_feature (521)..(521): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccgtcacgccccaggaagccctggagtggctgcgctcattatggatganagtaagcactacagtccgtctcgtgaagacaggctccaccatcacaaggaaccacctccaacaaaccaggtcgtccttaacaatgaccaatatcggacctgtagacacagccacatattactgttcacgtactctagtcggttacggggatttattaacgtcccttagtttgacttaacggngggtccacggggacttcgtgtccaccgttcaccgnaccgccnccaccgacggccgcgtcccg

SEQ ID NO: 359068 - DNA, 631 bp, Homo sapiens
  misc_feature: GZ8MTXP01AZ7WS.17.33.C11.1.454.CMB.2.raw
  modified_base (621)..(621): a, c, t, g, unknown or other
  misc_feature (621)..(621): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcctaccttctctggcttctcactcagaacgagtggaagtggggaggtgggctggactccgtcacgcccccgaggaacggcccgtggagtggcttgcgctctatttagttgggatagagagtaagcactacgagtccgtctcgtagaagaacaggctaccaccataccaaccaacgaaccacctaaccaacaaaccgaggtcgtacctaacaatacgaacctaagtacgtacggacccgtggtacggaaccaacacgaccaactattaacttactcgttaccgaacgtcttacgttagttggggttccggggtaagtttacgttaccgtttacccttacgtttcgaacgttcggtcgggggacttacggggtacttcgtcggtccacccgttcttcccgcacgccctccgacccgacgggtccccncggttccccg

SEQ ID NO: 359069 - DNA, 596 bp, Homo sapiens
  misc_feature: GZ8MTXP01AR83L.17.33.C11.1.454.CMB.2.raw
  modified_base (211)..(211): a, c, t, g, unknown or other
  misc_feature (211)..(211): n is a, c, g, or t
  modified_base (269)..(269): a, c, t, g, unknown or other
  misc_feature (269)..(269): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtncttccaacactggagcagtcaccagtgcttactatccaaactggttccagcagaaccnggacaagcacccaggcactcatttatagtacaaacaacaaacactcctcggaccccctgacccgattctcaggcctcccccctccgttgggggacaaagctcgccctgacactgtctggtgtgcagcctggaggacgaggctagacttattactcgtcctactcgttacgtttggggtggtgtccgtggtgtcgttagttcgggacgggtacggtaccgaagccgtgtaacccgttcgttaaacgtccgacgaccccgaacggttccgttccggccccctcggtccaaccgttccgtccgttccccgtccccttcccgttaaccccg

SEQ ID NO: 359070 - DNA, 733 bp, Homo sapiens
  misc_feature: GZ8MTXP01A88YE.17.33.C11.1.454.CMB.2.raw
  modified_base (229)..(229): a, c, t, g, unknown or other
  misc_feature (229)..(229): n is a, c, g, or t
  modified_base (280)..(280): a, c, t, g, unknown or other
  misc_feature (280)..(280): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttaccaacactggancagtcaccagtgtacttactataccaaacgtggtaccagacaacgaaaccnggaacaacgccacccgaggcactactatttaatacgtaacaaacaacaaacctacctcctaccggacccctcgcccgtacttctacgacgcccttccccccgtccggttacgggggacctaaacgcctaccgccctcggacctacgtcggttccgtgggtacggtcgaccgtacgtcccgtagggaacgggacgggacggtacgttacggtaaccttagttaccgtacgtacccttacttaccgttttacggtttcgggggttggttcgtcgttcggttacgtcgttacggttccgggacggggaacggtaaccgtaaggtccgttcggtaaccgttacgttaacggtccgaccggtaacccgtaacggttcccgttcccggttcccccggttccgtccccgtaaccgttccccggttcccgttaccccccgtccccgttcccgtttaacccg

SEQ ID NO: 359071 - DNA, 577 bp, Homo sapiens
  misc_feature: GZ8MTXP01D3VVM.17.33.C11.1.454.CMB.2.raw
  modified_base (274)..(274): a, c, t, g, unknown or other
  misc_feature (274)..(274): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggaggacagtcactctcacctgtgcttccaacactggagcagtcaccagtgtcttactactaccaaactggtccagcaagaaaccnggacaagcaccgaggcactctatttatagtaacaaacaacaaacactctacggacccctgccgattctcacggcctcccccgtccgttgggggacaaacgctacgccctgactacgtcgtctggtgtgcagccgtggacggacgaggctacgtacttatactcgtacctacttcttacgtttggggtgtgtctgtgtctagttcggcggacgacgaagtcgtgtaacgtcttaacgcacgaccgaagttccgttccgccccgtgtcctaacttcgtccgttccccgtcccttccgttaacccg

SEQ ID NO: 359072 - DNA, 688 bp, Homo sapiens
  misc_feature: GZ8MTXP01APN8O.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgcaccttctctggcttctcactcagaacgagtggaagtgggagtgggctggactccgtcacgccccgaggaacggccctggagtggcttgcgtctctatttagtggatgagagtaagcactacacgtccgtctacgtagaacgaacgaggactcccaccactaccaaacccgaaacggaacccaaccctaacccaaaccgtaaacccgtacgggttacggtacccttaacgaaacgttacgaacctaaatacgtacgggtaccctggtacggaaccacgacgaccaactattacgttacttcgttaccgacgtcttacgtaggttcggggttacggggttatttacgttaccgttcccttagtttacggtaccgttacgggtaacggggaccgttaaggggtaccttccgggtacggttcccgacccggttccttacccgggctacccggtcccctacccggaccgaccggggtcccttcggtttccccgg

SEQ ID NO: 359073 - DNA, 566 bp, Homo sapiens
  misc_feature: GZ8MTXP01BYNCW.17.33.C11.1.454.CMB.2.raw
  modified_base (452)..(452): a, c, t, g, unknown or other
  misc_feature (452)..(452): n is a, c, g, or t
  modified_base (466)..(466): a, c, t, g, unknown or other
  misc_feature (466)..(466): n is a, c, g, or t
  modified_base (476)..(476): a, c, t, g, unknown or other
  misc_feature (476)..(476): n is a, c, g, or t
  modified_base (491)..(491): a, c, t, g, unknown or other
  misc_feature (491)..(491): n is a, c, g, or t
  modified_base (540)..(540): a, c, t, g, unknown or other
  misc_feature (540)..(540): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
  modified_base (549)..(549): a, c, t, g, unknown or other
  misc_feature (549)..(549): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctggcttctcactcaagaacgagtggaagtggggagtggggctgggactaccggcgacgaccccgaaggaaaggccctggagtggcttgcgctctatttattgggatgagagtaagcactacagtcccgtctcgtagaagacaggctaccacactaccaaccaaggaaacccaccctccgaaaccaaaccgagggttacgtaccttaacaactacgacctaagtaactcgggacctgacggacacanaccatatattactnttcacgtctntagtgggttacgggnttatactccgtacttgctagtggggacagggtacttcgtgcacgttccncgcncnccncgacgacgtccgcgtcg

SEQ ID NO: 359074 - DNA, 611 bp, Homo sapiens
  misc_feature: GZ8MTXP01ATN04.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccgaggaaacggccctggagtggcttgcgctctatttagtggatgagagtagcaactacagtccgtctcagaagacaggctccaccataccgaccaaaggaaccacctccaacgaaaccgtagggtacgtaccttaacaatacgaaccctaatacgtcggaccctgtacggacacgacgcccatattacttactcgttcgacgtcttactaggttcgggttacggggtatttacgtttacgtcccttagtttgacgttacggtggggaccttaggggaacttcgtcgggtccttacccgttcgttcccgcgacgtcccgtaccacccggacgggtccccttaacgtttccccgg

SEQ ID NO: 359075 - DNA, 591 bp, Homo sapiens
  misc_feature: GZ8MTXP01BZUW3.17.33.C11.1.454.CMB.2.raw
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
  modified_base (335)..(335): a, c, t, g, unknown or other
  misc_feature (335)..(335): n is a, c, g, or t
  modified_base (374)..(374): a, c, t, g, unknown or other
  misc_feature (374)..(374): n is a, c, g, or t
  modified_base (406)..(406): a, c, t, g, unknown or other
  misc_feature (406)..(406): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactgtccagcagaaaccnggacaagcaccaggcactctatttanagtaacaaacaacaaacactccacgacccctgccgattcncagcctcccctccgtggggacaaacgctacgccctgacncgtgtcgtggtgtgcagccgtaggagggacgnggctacgacttatacgtcgtcctaacttcttacgtttggggtcgtgtctggtgtcgtacggttcgggcgggtacgggacctaaggccgtcggtaaccgttacgttacgtcgacgacccgaaggttcccgttccgcccctcggtcctaaccttcctcccgtttcccctaacccgttccttaacccg

SEQ ID NO: 359076 - DNA, 646 bp, Homo sapiens
  misc_feature: GZ8MTXP01DL2GP.17.33.C11.1.454.CMB.2.raw
  modified_base (271)..(271): a, c, t, g, unknown or other
  misc_feature (271)..(271): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtcaccagtgcttactatccaaactggttccagcagaaaccnggaacaagcaccagggcactcatttatagtaacaaacaaacaaacactcctggacccctgcccgattctcaggcctcccctccgtgggggcaaagctgccctgacacgtgtctgggtgtcgcagccgtggacggacgaaggcgtagacttattactcgccctaacttcttaacgttttggggtcggttgtctggttcgcgttagtttccgggacgggtacggggtaacccgaaagtccgtcggtaacccggttactttaaacggtccgttaacggaccccgaaacgggttcccgttcccggttcccccccgttccgggtacccgtaacccttccgttcccggtttccccccggcccctttaaccccgttccccgg

SEQ ID NO: 359077 - DNA, 705 bp, Homo sapiens
  misc_feature: GZ8MTXP01CO545.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaacggccctggagtggcttgcgctcatttattgggatgagagtaagcactacagtccgtctctagaagaacaggctacccaccatcaaccaagaaccacctcccaacaaaccgagggtacggtacctaacaatcgaaccaaatacgtacgggaccctggtacggaacaacgacgacccaataacttaactttactcgtttaccgaaccggtcttccgttaagtttcgggggtttccggggtaagttttaacgtttaccggttacccctttaacgttttacggtaacccgttacgggtccggggggtaacccgttaaacgggggttaaacccttccggttaaacggggttcccttaaccccggggttcccttcccgggaaccctaacggcccccttacccgaccccggttaaaccggggtcccccttaacggtttccccccggg

SEQ ID NO: 359078 - DNA, 683 bp, Homo sapiens
  misc_feature: GZ8MTXP01EF4ST.17.33.C11.1.454.CMB.2.raw
  modified_base (331)..(331): a, c, t, g, unknown or other
  misc_feature (331)..(331): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagacccctcacgctgacctgctaccttctctggcttctcactcagaacgagtggaatggggagtgggctggactccgtcacgccccaggaacggccctggagtggcttgcgctctatttagttgggatgagagtaacgcactacagtcccgtntcgtgaacgacaggctaccaccatcaaccaacggaacccaccctaaccaacaaacccgtacgggtacgttaccctttaacaattacgaacctaaagttacgtacgggtaaccctggtacggaaccaacacgccccaatacttaatttactcggtttcaacggttcttaccgttaggttcgggggtttaccggggtagttttacttaaaccggtttcccttaacgtttttacggaaccgttacgggtcgggggacccttaagggggtacccttcggtcggggtcccttacccgggttcttcccgggcaacggtcccctacccgacggaccggggtcccaacggtttccccggg

SEQ ID NO: 359079 - DNA, 690 bp, Homo sapiens
  misc_feature: GZ8MTXP01A0B8Q.17.33.C11.1.454.CMB.2.raw
  modified_base (216)..(216): a, c, t, g, unknown or other
  misc_feature (216)..(216): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaaccccacacagacccctcacgctgacctgccaccttctctggcttcncactcagaacgagtggaatggggagtgggctggatccgcacgccccaggaacgccctggagtggcttgcgctctatttagtgggatgagagtaagcactacagtccgtctactagaagaacgacggctacccaccatacccaaccgaaacggaacccaaccctaaccaaaccgaaaacccgaggggttacgtaccttaacgaaattacgaaaccctaaagtaactcggggaacccttggacggaaccacgaacgaccccaataagttactttaacctggtttaccaaccgggtctttactagggttcggggtttaccgggggtattttaactttacgtttccccttagttttacgaaccgttcgggtcgggggtacccttaagggggtaaccttccgtaacggttcccgacccgtttcgcccggtaacacccggtccccaccgaacccgacgggccccttaacggtttccccgg

SEQ ID NO: 359080 - DNA, 553 bp, Homo sapiens
  misc_feature: GZ8MTXP01C7S00.17.33.C11.1.454.CMB.2.raw
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaaacctggacaagcaccaggcactcatttatagtaacaaacaaacaaacactccctacggacccctgccccgtattctccacgcctccgtcgtggggcaaaacggctcgccctgacctactgtctggtgtgcagcctggacggacgaggctgtactattactcgtacctacttcgttacgtttgggtcgtgtcgtgtgcttagtcggacggtaggacagctacgttccgtcttagtcgacgccgacgttcctccgcccctcgtccacttcctccgttccctaaccc

SEQ ID NO: 359081 - DNA, 659 bp, Homo sapiens
  misc_feature: GZ8MTXP01COZ65.17.33.C11.1.454.CMB.2.raw
  modified_base (240)..(240): a, c, t, g, unknown or other
  misc_feature (240)..(240): n is a, c, g, or t
  modified_base (274)..(274): a, c, t, g, unknown or other
  misc_feature (274)..(274): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttaccaacactggagcagtcaccagtncttactataccaaactggttacaagcagaaaccnggacagcaccaggcactcatttatacgtaacaaacaacaaactactcctacggaaccccctgacccgtaattccactacgaccttccccctaccggttgggggactaaacgctcgccctgacacttcggtctagggtctggccacgtccgtggaagggacgaggtctaggtaactatttaacctgtacccttaacttcttaccggttttgggggtcggttcggtcgtggttacgtcgttacgttcggggacgggaacggtaccgaaagtccgtacggtaaccgttatttaaaggcccaacggtccccgaaggttcccgttccggttccccccgttggtaccctccgttccgttcccggttacccctccccgttcctttaaccccg

SEQ ID NO: 359082 - DNA, 589 bp, Homo sapiens
  misc_feature: GZ8MTXP01C8034.17.33.C11.1.454.CMB.2.raw
  modified_base (357)..(357): a, c, t, g, unknown or other
  misc_feature (357)..(357): n is a, c, g, or t
  modified_base (374)..(374): a, c, t, g, unknown or other
  misc_feature (374)..(374): n is a, c, g, or t
  modified_base (431)..(431): a, c, t, g, unknown or other
  misc_feature (431)..(431): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
  modified_base (543)..(543): a, c, t, g, unknown or other
  misc_feature (543)..(543): n is a, c, g, or t
  modified_base (554)..(554): a, c, t, g, unknown or other
  misc_feature (554)..(554): n is a, c, g, or t
tcagcgtagactagcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccggacaaccgtcgcccggcaacatacgccttctcccgtcccccttgcagtaacaccaagtacagaatattaacctgttcccatcgactacgcctttcggcctcgccttaggggtcactcaccctgccccgattaacgtggacaggacccttggtctcggngagcggctttcaccgtntttatcgttacctatgtcagcaattcgctactttctgactaccctcagcatcgcctnacagccactaccttcacaggtcttacagtaaccgcctaccccctaacccaaacaaccgcaactaacgcgtaccgctcgcccgcngtcttcggnccgttagttcgggtttacncccccgttttnaccttccctcccgctctcgttacgtaacgttcgtc

SEQ ID NO: 359083 - DNA, 627 bp, Homo sapiens
  misc_feature: GZ8MTXP01EB77J.17.33.C11.1.454.CMB.2.raw
  modified_base (271)..(271): a, c, t, g, unknown or other
  misc_feature (271)..(271): n is a, c, g, or t
  modified_base (293)..(293): a, c, t, g, unknown or other
  misc_feature (293)..(293): n is a, c, g, or t
  modified_base (399)..(399): a, c, t, g, unknown or other
  misc_feature (399)..(399): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttccaacactggagcagtcaccagtgcttacatccaaactggtcagcaagaaaccngacagcaccaggcactcattanagtaacaaacaacaaacactccacggacccctcgcccgtattcctacacggtcctccccccgtccggttgggggacaaacgcctacgcctgacactgtctggtcgngcagccgtaggacggacggagcgtacgtaacttacgttactcgtaccctacgttcttacggtttgggggttggttgtccgttggtgtcgttaggtccgggacgggacggtaccgaacgtcgtacggtaacgttcgttaacggtcaacggacccgtaacgggcccgttcccggccccgttcggtcctaaccgttcggttcccttacccctaacccgttcctaaccccgg

SEQ ID NO: 359084 - DNA, 566 bp, Homo sapiens
  misc_feature: GZ8MTXP01D2A3Y.17.33.C11.1.454.CMB.2.raw
  modified_base (273)..(273): a, c, t, g, unknown or other
  misc_feature (273)..(273): n is a, c, g, or t
  modified_base (343)..(343): a, c, t, g, unknown or other
  misc_feature (343)..(343): n is a, c, g, or t
  modified_base (434)..(434): a, c, t, g, unknown or other
  misc_feature (434)..(434): n is a, c, g, or t
  modified_base (539)..(539): a, c, t, g, unknown or other
  misc_feature (539)..(539): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcaagaaaccnggacaagcaccagggcactcattataagtaacaaacaacaaaacactacctcgacccctcgccgattccncacgcctcccccgtccgttgggggacaaagctacgccctgacactgtctgggtgtgcagccgtggacggacgaggactgtaacttattacncgtcctactcgttacgtttggggtgttgtcgtgtgtctagttcggcggacggtaccaagtctgtaacgtcttaagtcacgcccgaagccttcgcccctcggtccncgtctcgttacccctcccttccgtccc

SEQ ID NO: 359085 - DNA, 665 bp, Homo sapiens
  misc_feature: GZ8MTXP01EV6NZ.17.33.C11.1.454.CMB.2.raw
  modified_base (314)..(314): a, c, t, g, unknown or other
  misc_feature (314)..(314): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgctaccttctctggcttctcactcagaacgagtggaatgggagtgggctggactccgtcacgccccccgaggaaacggccctggagtggcttgcgctctatttatgggatgagagtaancactacagtcccgtctctagaagaacaggctccaccataccaaccaacggaacccaaccctaacccaaaccaaaacccgtacgggttacggttaccctttaacgaaacttacgaaaccctaaatacgtacgggaaccccttggtacggaaccacgaacgacccaactattaacttacgtcgtttaccaccgtacgttacgttaaggttcggggttaccggggtaagttttaacgtttacggttacccttacgtttacgaccgttacggtcggggaccgttaggggtaaccttcggtcgtccaccgttcttccgcacgccctaccgaccgacgggtcccttaacgttccccg

SEQ ID NO: 359086 - DNA, 762 bp, Homo sapiens
  misc_feature: GZ8MTXP01BOIYB.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgtcacgccccgaggaaacggccctggagtggcttgcgctctatttatgggatgagagtaagcaactacacgtcccgtctacgtagaaacgaacgaggacctacccaaccactaccaaacccgaacggaacccaaccctaaccaaaccaaacccgtacgggtacggtacccttaacaaatacgaaaccctaaagttacgtacgggtaaccccttaggaacggaacccaaccgaacgaccctaaactaactttaactttaaaccgttccggtttaaccgaacccgttaccgtttacgtttaacgggtttaccgggggtttaccgggggttaacgttttaaccgtttaaccgggttcccctttaacgttttaccgtaccgttaaccgggtcgggggtaaccgttacgggggtaaaccttcggttaccgggtcccttaaccccggttcttaccccggcgtacccggtccccttacccgaccggaacccggggtccccttaaccggtttcccccggg

SEQ ID NO: 359087 - DNA, 577 bp, Homo sapiens
  misc_feature: GZ8MTXP01DJ9CQ.17.33.C11.1.454.CMB.2.raw
  modified_base (227)..(227): a, c, t, g, unknown or other
  misc_feature (227)..(227): n is a, c, g, or t
  modified_base (271)..(271): a, c, t, g, unknown or other
  misc_feature (271)..(271): n is a, c, g, or t
  modified_base (294)..(294): a, c, t, g, unknown or other
  misc_feature (294)..(294): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcacctgtgcttccaacactggancagtcaccagtgcttactatccaaactggttccagcagaaaccngacagcaccaggcactcatttanagtacaaacaacaaacactcctcgacccctgcccgtattctcacggtcctccccccgtccgttacgggggcaaacgcctacgccctgacctactcgtacgtggtgtgcagccgtgacggacgagctagtacttattactgcctactacttacgtttggggtggtgtcttgcgtcgtagttcggacggtacggaccaagcgtcgtaaccgttcttaacgtcacgacccaaggccgttccgaccccgtcggtctaacctctccgttccccgtcccttccttcccg

SEQ ID NO: 359088 - DNA, 654 bp, Homo sapiens
  misc_feature: GZ8MTXP01BHV3R.17.33.C11.1.454.CMB.2.raw
  modified_base (355)..(355): a, c, t, g, unknown or other
  misc_feature (355)..(355): n is a, c, g, or t
  modified_base (388)..(388): a, c, t, g, unknown or other
  misc_feature (388)..(388): n is a, c, g, or t
  modified_base (401)..(401): a, c, t, g, unknown or other
  misc_feature (401)..(401): n is a, c, g, or t
  modified_base (417)..(417): a, c, t, g, unknown or other
  misc_feature (417)..(417): n is a, c, g, or t
  modified_base (432)..(432): a, c, t, g, unknown or other
  misc_feature (432)..(432): n is a, c, g, or t
  modified_base (442)..(442): a, c, t, g, unknown or other
  misc_feature (442)..(442): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccgtcacgcccccaggaaacggccctggagtggcttgcgtctctatttagtgggatggagagtagctaactacacgtccgtctctagaagaacaggctaccacctancaaccaacggaacccaacctccaacaaacccgnggtcgtaccttanaatacgaaccaatacncggaccctgcgaacncgacgaccanatacttactgttcaacggtctcgttagttgggttaccggggtatttacgttacggtcccttacgtttcgacgttacggtaacgggggtccgagggggtaaccttccggtacgggttcccttaacccgggttcccgttccccgggaaccaccggtcccccttacccgacccgggttaaacccggggtccccttaacggttttcccccccgggg

SEQ ID NO: 359089 - DNA, 570 bp, Homo sapiens
  misc_feature: GZ8MTXP01DQ7D0.17.33.C11.1.454.CMB.2.raw
  modified_base (325)..(325): a, c, t, g, unknown or other
  misc_feature (325)..(325): n is a, c, g, or t
  modified_base (496)..(496): a, c, t, g, unknown or other
  misc_feature (496)..(496): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcacctttctctggccttctcactcagaacgagtggaatgggagtgggctggatccgtcagcccccaggaaaggccctggagtggcttgcgtctcatttatgggatgagagtagcactacagtcccgtntctagaagaacaggcctccaccatcaccaacgaaccaccctccacaaaccaggtcgtaccttacaatgaccaatatcggaccctgtaggaacacagaccacataattactgttcaacgtcttctagttgggttcgggtagttatttaacgttcccttagtttgacttacgngggtccagggtaccttgtcggtcaccggttcttcccgcacgtcctcccaccgaacgggtccccaagttccccgg

SEQ ID NO: 359090 - DNA, 607 bp, Homo sapiens
  misc_feature: GZ8MTXP01BVQ8W.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgcagcccccaggaaggccctggagtggcttgcgctctatttagtggatgagagtaagcactacagtccgtctctagaagacaggctacaccatcaccaaggaaccaccctccaacaaaccgaggtacgtaccttacaatacgaaccaatactcgggaccctgtagggacacacgccactatattactgttcacgtcttctaagttcgggttacgggtagtttacgtttaccggttccctttaacgtttcgaccgttacggtcgggggccttaacgggggtaacttcgtcgggtccttacccgttccgttcccgcacggtccctcccacccgaacggggtccccttaagtttccccggg

SEQ ID NO: 359091 - DNA, 699 bp, Homo sapiens
  misc_feature: GZ8MTXP01EOR3Y.17.33.C11.1.454.CMB.2.raw
  modified_base (311)..(311): a, c, t, g, unknown or other
  misc_feature (311)..(311): n is a, c, g, or t
  modified_base (358)..(358): a, c, t, g, unknown or other
  misc_feature (358)..(358): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagacccctcacgctgacctgcaccttctctggcttctcactcagaacgagtggaatgggagtgggctggatccgtcagcccccaggaacggccctggagtggcttgcgctcatttattgggatgaagagtaancgaactacgagtccgtctactagaaacgaacgacggctacccaccanaccaaccaacggaacaccctccaaacaaacctagggtacgtaaccttacgaatacgaacctaaatacgtcggaccctaggtacggaacacgtacacccaacaataacttaactcgttaccgacgtcttaccttaggttggggttaccgggtaagtttacgtttaaccggttccctttaaacgttttcgaaccgttacgggtcgggggtaccgttaaacgggggtaaaccctttcgtaccgggggtttacccaaccccggtttccgttccccgggtaaccctaaccgggccccttaccccgaaccggaaaccggggtccccttaaaccggttttcccccggg

SEQ ID NO: 359092 - DNA, 595 bp, Homo sapiens
  misc_feature: GZ8MTXP01A6CIZ.17.33.C11.1.454.CMB.2.raw
  modified_base (228)..(228): a, c, t, g, unknown or other
  misc_feature (228)..(228): n is a, c, g, or t
  modified_base (278)..(278): a, c, t, g, unknown or other
  misc_feature (278)..(278): n is a, c, g, or t
  modified_base (306)..(306): a, c, t, g, unknown or other
  misc_feature (306)..(306): n is a, c, g, or t
  modified_base (471)..(471): a, c, t, g, unknown or other
  misc_feature (471)..(471): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggancagtcaccagtcgcttactataccaaacgtggttcccagcaagaaacccnggaacaagccaccagggcactcatttanagtaacaaacaacaaacactcctagacccctgccgattctcaggcctccccctcgttaggggcaaacgctacgccctggactacgtcgtcgtggtgtcgcacgccgtgacgggacgacgcgttacgactattacgcgaccttactcttacgttgggggtgtcgtntgtgtctacgttcgggacggagggaccctaagcgtcggtaaccgtcttaacggcacgacccgtaaggccgttcccgccccgtcggtaccaaccgttctccggttcccctcccttccgttccccg

SEQ ID NO: 359093 - DNA, 580 bp, Homo sapiens
  misc_feature: GZ8MTXP01DD4UD.17.33.C11.1.454.CMB.2.raw
  modified_base (227)..(227): a, c, t, g, unknown or other
  misc_feature (227)..(227): n is a, c, g, or t
  modified_base (271)..(271): a, c, t, g, unknown or other
  misc_feature (271)..(271): n is a, c, g, or t
  modified_base (341)..(341): a, c, t, g, unknown or other
  misc_feature (341)..(341): n is a, c, g, or t
  modified_base (389)..(389): a, c, t, g, unknown or other
  misc_feature (389)..(389): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggaggacagtcactctcacctgtgcttccaacactggancagtcaccagtgcttactatccaaactggtccagcaagaaaccnggacaagcaccaggcactcatttatagtaacaaaacaaacaaacactccacggacccctcgcccgattcncagcctccccctccgtggggacaaacgctcgccctgacactgtctggngtgcacgcctaggacgacgagctagactacttactcgtcctaactcttacgttggggtgtgtctgtgctagttcggacggacgggaccgaaagcgtgaaccgggttcttaacgcgacgaccccgtaaggcccgttcgcccccgttcgggtccctaacgtccgtccgttccccgtccccttcccttaacccg

SEQ ID NO: 359094 - DNA, 568 bp, Homo sapiens
  misc_feature: GZ8MTXP01B1ADP.17.33.C11.1.454.CMB.2.raw
  modified_base (220)..(220): a, c, t, g, unknown or other
  misc_feature (220)..(220): n is a, c, g, or t
  modified_base (268)..(268): a, c, t, g, unknown or other
  misc_feature (268)..(268): n is a, c, g, or t
  modified_base (333)..(333): a, c, t, g, unknown or other
  misc_feature (333)..(333): n is a, c, g, or t
  modified_base (415)..(415): a, c, t, g, unknown or other
  misc_feature (415)..(415): n is a, c, g, or t
  modified_base (488)..(488): a, c, t, g, unknown or other
  misc_feature (488)..(488): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacnctggagcagtcaccagtgcttacatccaaactggttccagcagaaacnggacaagcaccaggcactcatttatagtacaaacaacaaacactcctggacccctgcccgattcncacggctccccctccgttggggcaaagctacgccctgacactgtctggtgtgcagcctggaggacgaggctagactattacngcctactacttacgtttgggggtgtgtctgtgcttagttcgggacggtacgggtaccaagctggtaacccgtnttaaacggcttacgcccgaaggttccgttccgccccctcggtccaacgttcctcgttcccctaacccgttcccgttcccg

SEQ ID NO: 359095 - DNA, 587 bp, Homo sapiens
  misc_feature: GZ8MTXP01AIR64.17.33.C11.1.454.CMB.2.raw
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccnggacaagcactcaggcactcatttanagtaacaaacaacaaacactcctgaccccctgcccgattctcaggccctccctcgtgggggccaaagctgccctgacactgtctgtgtgcacgcctgaggacgaggctgactattactgcctactcttacgtttggtggtgtcgtgtgctagttcggcgggtagggacccaagtctcggtacccgttacgtttaaacggttccgaacgaccccgaagggttcccttccgtcccccccggtccgggtccctacccttcccgttccggtttcccccgttccccgttcccccg

SEQ ID NO: 359096 - DNA, 617 bp, Homo sapiens
  misc_feature: GZ8MTXP01A9X50.17.33.C11.1.454.CMB.2.raw
  modified_base (329)..(329): a, c, t, g, unknown or other
  misc_feature (329)..(329): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggactccgtcacgcccccaggaacggccctggagtggcttgcgctctatttagttgggatgagagtaacgcactacagtcccgtntcgtagaaacgacaggctccaccatccaaccaaggaaccaccctccaacaaaccgaggtcggtaccttaacaatacgaacctaatagtcggaccctgtacggaaccacgacaccaatattaacttactacgttacacgtctttccgtaagttcggggttaccgggtagtttacttacggtcccttagtttcgactcggtggggtcccaggggtaccttcgtcggtaccgttccgttcttccggcacccgtcctacccacggttaacgggtccccaacgtttccccggg

SEQ ID NO: 359097 - DNA, 601 bp, Homo sapiens
  misc_feature: GZ8MTXP01BI25G.17.33.C11.1.454.CMB.2.raw
  modified_base (559)..(559): a, c, t, g, unknown or other
  misc_feature (559)..(559): n is a, c, g, or t
  modified_base (563)..(563): a, c, t, g, unknown or other
  misc_feature (563)..(563): n is a, c, g, or t
tcagcgtagactagcacgaccggtgctcgatttagagtgagctcgttgggtttgggggactcctgtagccccaccatggacacactttgctccacgctcctgctgctgaccatcccttcatgggtcttgtcccagatcaccttgaaggagtctggtcctacgctggtacgaaacccacacagaccctcacgctgacctgcaccttctctggcttctcactcagaacgagtagaaagtgggagtgggctggatccgtacacgacccccgaggaaacggccctggagtggcttgcgctctatttagttggatgagagtaagcactacgtacgtccgtctcgtagaagaacgaggcctaccaccacacaaccaacggaacccacctaaccaacaaaccgagggtacgtaccttacaaactacgaacctaatagtacggaccttgacggacaacacgaccaacatattactgttacacgtcttactagttgggtacgggtatttagttacgtcccttattgacgtggtcgggacttagggtacttcgtcgtcgttaccgttcnccgntaccgcctaccgaccgttacggcccgttaagttcccgg

SEQ ID NO: 359098 - DNA, 564 bp, Homo sapiens
  misc_feature: GZ8MTXP01A649T.17.33.C11.1.454.CMB.2.raw
  modified_base (440)..(440): a, c, t, g, unknown or other
  misc_feature (440)..(440): n is a, c, g, or t
  modified_base (526)..(526): a, c, t, g, unknown or other
  misc_feature (526)..(526): n is a, c, g, or t
  modified_base (544)..(544): a, c, t, g, unknown or other
  misc_feature (544)..(544): n is a, c, g, or t
tcagcgtagactagcacgaccggtgctcgatttagagtgagctcgttgggtttgggggactcctgtgcccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgcacgccccaggaagcctggacgtggcttgcgctctattagtgggatgagagtaagcactacgagtccgtctcgtagaagaacaggctccaccatccaaccgaacggaaaccaccctccaaacaaaccgagggttacggtaccttaacaacttacgaacctaaatatacgggacctgtacggacacagccanatacttactgttcgactctaccttagtggttcgggtagttattacgtccttacttgactgtcgggggccagggacttcgtaggtcnccgttcttcggcacgccncaccgacggccttgtcccgg

SEQ ID NO: 359099 - DNA, 627 bp, Homo sapiens
  misc_feature: GZ8MTXP01BHAI7.17.33.C11.1.454.CMB.2.raw
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
  modified_base (387)..(387): a, c, t, g, unknown or other
  misc_feature (387)..(387): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgccaccttctctggcttctcactcagaacgagtggaatggggagtgggctggatccgtcacgccccaggaacggcctggagtggcttgcgctctatttagtgggatgagagtaagcactacagtccgtctctgaanacngctccaccatcaccaacgaaccacctccaacaaaccgaggtcgtaccttaanaactacgaacctaaatacgtcgggaacccttggacggaaccacacggacccatatacttactcgttcacgtcttcgttagttcgggttcgggtagtttacgttaaccggttcccttacgtttgaaccgttcggtcggggtaccgaaggggtaccttccgtacggggtcccttacccgttcgacccggccttaccgccccttacccgaccggttaaccgggtccccaacggtttcccccgg

SEQ ID NO: 359100 - DNA, 617 bp, Homo sapiens
  misc_feature: GZ8MTXP01DEOKY.17.33.C11.1.454.CMB.2.raw
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
  modified_base (449)..(449): a, c, t, g, unknown or other
  misc_feature (449)..(449): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccagggaggacagtcactctcacctgtgcttccaacactggagcagtcaccagtgtcttaactataccaaacttggttaccagacaacgaaaccgtggaacaacgcaacccgagggcactntatttanagtaacaaacaaacaaacactcctacgaccctcgaccgtattctacacgtacctcccccgtcgtggggacaagctacgccctgacactcgtctaggtgtgacacgcgtaggacggacgagctacgtacttattacncgtcctacgttcttacgtttggggtgttgtctcgtagtcgtacgttcgggacggtacggtaccgaacggctcggtaaccgttgttaacgtcaccgacccgtaacggccgttcccgttccccgtcggtacctccttccttaccgttcccctaaccgttcccttaacccg

SEQ ID NO: 359101 - DNA, 540 bp, Homo sapiens
  misc_feature: GZ8MTXP01A5WNZ.17.33.C11.1.454.CMB.2.raw
  modified_base (213)..(213): a, c, t, g, unknown or other
  misc_feature (213)..(213): n is a, c, g, or t
  modified_base (489)..(489): a, c, t, g, unknown or other
  misc_feature (489)..(489): n is a, c, g, or t
  modified_base (510)..(510): a, c, t, g, unknown or other
  misc_feature (510)..(510): n is a, c, g, or t
  modified_base (517)..(517): a, c, t, g, unknown or other
  misc_feature (517)..(517): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttcncactcagaacgagtggaatgggagtgggctggatccgtcagccccaggaaagccctggagtggcttgcgctcatttatggatgagagtaagcactacagtcccgtctctagaagaacaggctaccaccatcaaccaaggaaccacctccaacaaacacggtcgtaccttaacaatacgaccaaatataggaccctgtggacacagcacatactatgtcacgtctctagtggtcgggtattagttacgtccctattcgactacgtgggcagggtacncgtaggtcaccgttcttccgnacgtccnccacgacgggccttaacgtcccg

SEQ ID NO: 359102 - DNA, 616 bp, Homo sapiens
  misc_feature: GZ8MTXP01AVECH.17.33.C11.1.454.CMB.2.raw
  modified_base (227)..(227): a, c, t, g, unknown or other
  misc_feature (227)..(227): n is a, c, g, or t
  modified_base (321)..(321): a, c, t, g, unknown or other
  misc_feature (321)..(321): n is a, c, g, or t
  modified_base (336)..(336): a, c, t, g, unknown or other
  misc_feature (336)..(336): n is a, c, g, or t
  modified_base (397)..(397): a, c, t, g, unknown or other
  misc_feature (397)..(397): n is a, c, g, or t
  modified_base (580)..(580): a, c, t, g, unknown or other
  misc_feature (580)..(580): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacaaacccacacagaccctcacgctgacctgcaccttctctggcttctcactcaagaacgngtaggaatggggagtgggctgggactccgtcacgaccccgaaggaacggccctaggagtggcttgcgtctactatttagtggatgagtagtaancaatacacgtccgtntcgtagaaagaactacggcctccaccactccaaacgaacgaacaccctccaaacaaaccgngggttacgtaccttaagaactacgaactaatactcggaccctgacggaacacacgaccaatattacttactcgttcaacgtcttactaggttcggttcggggtatttacgttacggtccccttagtttgacgtttacggcggggacttacgggtacttcgttcggcccttaccgcttcccggnacgccctaccgacgacgggcccttaacggttccccg

SEQ ID NO: 359103 - DNA, 587 bp, Homo sapiens
  misc_feature: GZ8MTXP01A9ZF5.17.33.C11.1.454.CMB.2.raw
  modified_base (293)..(293): a, c, t, g, unknown or other
  misc_feature (293)..(293): n is a, c, g, or t
  modified_base (343)..(343): a, c, t, g, unknown or other
  misc_feature (343)..(343): n is a, c, g, or t
  modified_base (375)..(375): a, c, t, g, unknown or other
  misc_feature (375)..(375): n is a, c, g, or t
  modified_base (423)..(423): a, c, t, g, unknown or other
  misc_feature (423)..(423): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgcacgaccccaggaacgcctggagtggcttgcgctctagtttntggatgagagtaagcactacagtccgtctctagaacgacaggctccacanacaaccgaagaacccactccaaacaaacccgnggtacgtaccttaacaactacgaccaatacgtcgacctgacgaaccanacacactatactactgtcacgtcacgttagtgggttacgggtgttaacttcgtcccttaagttgaaccgttggcgggtacccgaggggtacttcggtacgttcgcccgttcgacccgaacgccgttccccacggacccgttaacgggccccttaagttccccgg

SEQ ID NO: 359104 - DNA, 641 bp, Homo sapiens
  misc_feature: GZ8MTXP01EZ1U5.17.33.C11.1.454.CMB.2.raw
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacnctggancagtcaccagtgcttactatacctaaactggttaccagcaagaaaccnggacaagcacccaggcactcatttanagtaacaaacaacaacactccacgacccctgcccgattcctcacggcctcccccgtcgttggggacaaacgctacgccctgaccactgtctgggtgtacgcgacgccgtggaacgggagaggctagacttattactcgtcctacttcttacgtttggggtggtgtcgtgtcgtcgtacgttcgggacggtaacgggtaccaaacggtcgtacggtaacccgttacgtttaaaccggtcgaaccgaccccgtaacgggcccgttcccgttacccccccgttcggtaccctaaccctttcccgtcccggtttccccctaacccccgtttcccgttaaccccg

SEQ ID NO: 359105 - DNA, 659 bp, Homo sapiens
  misc_feature: GZ8MTXP01AK6NF.17.33.C11.1.454.CMB.2.raw
  modified_base (612)..(612): a, c, t, g, unknown or other
  misc_feature (612)..(612): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgcctaccttctctggcttctcactcagaacgagtggaagtgggagtgggctggatccgtacacgccccgaggaacggccgtggagtggcttgcgtctactagtttagttgggataggaagtagtaacgctacgtactacgtccgtctacgtagaaacgaacgacggacctaccaaccataccgaacccgaaacgaaacccaaccctaacccaaacgaaaccgtagggttaccgtaccttaacaaactacgaaacctaagtacgtacggaccctaggtacggaacacacgaccaacttattacttactcggttacacgtcttacgtaggttgggttcgggtatttacgttacgttccctagtttcgacgttcggtcgggaccgttagggtaccttcggtacgtccttaccggttcncccggcaccgtccctaccgacccggacggtccccttaagttccccgg

SEQ ID NO: 359106 - DNA, 677 bp, Homo sapiens
  misc_feature: GZ8MTXP01C43MY.17.33.C11.1.454.CMB.2.raw
  modified_base (171)..(171): a, c, t, g, unknown or other
  misc_feature (171)..(171): n is a, c, g, or t
  modified_base (229)..(229): a, c, t, g, unknown or other
  misc_feature (229)..(229): n is a, c, g, or t
  modified_base (276)..(276): a, c, t, g, unknown or other
  misc_feature (276)..(276): n is a, c, g, or t
  modified_base (306)..(306): a, c, t, g, unknown or other
  misc_feature (306)..(306): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctnactgactgtcgtccccagggagggacagtcactctcacctgtgcttccaacactggancagtcaccagtgcttactataccaaactggtaccagacaagaaaccnggaacaacgcaccgaggccactctatttanaagtaacaaaacaacaaacactcctacggacccctgcccgtattctcgacgcctcccccgtccggtggggactaaacgctaacgccctgactactgctggtgtgcacgccgtgacggacgagctacgtactattactcgtacctacttacgttacgtttggggtggttcgtcgttgtcgtcgttacggttcgggaacgggtacgggaacctaaacggtccgtacggtaacccgtttaacgtttaaacgtaccgaaccggttaccccggaaacggggttccccttcccggttcccccccggttcgggttaccccttcccgtttccccgttccccggtttccccccggtccccctttccccgtttaaccccgg

SEQ ID NO: 359107 - DNA, 615 bp, Homo sapiens
  misc_feature: GZ8MTXP01BZ0GG.17.33.C11.1.454.CMB.2.raw
  modified_base (213)..(213): a, c, t, g, unknown or other
  misc_feature (213)..(213): n is a, c, g, or t
  modified_base (331)..(331): a, c, t, g, unknown or other
  misc_feature (331)..(331): n is a, c, g, or t
  modified_base (386)..(386): a, c, t, g, unknown or other
  misc_feature (386)..(386): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttcncactcaagaacgagtggaagtgggagtgggctggatccgtcacgccccaggaaacggccctggagtggcttgcgctctattagtggatgagagagcactacagtccgtctctagaaanaacaggctacccacctataccaaccaaacggaaccaaccctccaaacaaaaccgnggtacgtaccttaacgaatacgaacctaataacgtcggaaccctgtacggaacacagacccaatatacttactgttcacgtctactaggtggtcggtaattacgttacgtccttacgtttcgacttacggtcggggccgagggaaaccttcgtacgggtccaacccgggtttccacccggtcaccggtccctcccgaaccgaaccggggtccccttaacgtttccccgg

SEQ ID NO: 359108 - DNA, 622 bp, Homo sapiens
  misc_feature: GZ8MTXP01CUXX0.17.33.C11.1.454.CMB.2.raw
  modified_base (291)..(291): a, c, t, g, unknown or other
  misc_feature (291)..(291): n is a, c, g, or t
  modified_base (329)..(329): a, c, t, g, unknown or other
  misc_feature (329)..(329): n is a, c, g, or t
  modified_base (359)..(359): a, c, t, g, unknown or other
  misc_feature (359)..(359): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagaccctcacgctgacctgccaccttctctggtcttctcactcagaacgagtaggaagtgggagtcgggctggactcggcacgacccaggaacgcctggagtggcttgcgctntatttagtggatgagagtaagcaactacgagtcccgtntacgtagaaacgaacaggcctacccaccanaccgaaaccaacggaaccctacccaaccaaacaaaccgtagggtacgtaccttaacgaacgtacgaacctaatacgtcggaccttggacgacacacgaccacatactactagttacacgtcttacgtagttcgggttacgggtatttacgttaccgtcctttacgttgaccgtaccggtggggccttacgggtacttcgtacggtccttaccgttcgttaccgcgacctccgtacccacggttaaccggccttcgttccccgg

SEQ ID NO: 359109 - DNA, 655 bp, Homo sapiens
  misc_feature: GZ8MTXP01BB4ZN.17.33.C11.1.454.CMB.2.raw
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (332)..(332): a, c, t, g, unknown or other
  misc_feature (332)..(332): n is a, c, g, or t
tcagcgtagactagcacgaccggtgctcgatttagagtgagctcgttgggtttgggggggcgccaggggtcccttccaatatcagcaccatggcctggactcctctctttctgttcctcctcacttgctgcccagggtccaattctcagactgtggtgactcaggagccctcactgactgtcgtcccagggagggacagtcactctcacctgtcncttaccaacnctggancagtcacagtcgcttacataccaaacgtgtccagcaagaacngacacgcaccgaggcactntattanaataacaaacaaacaaacactccgtacgaccccncgacctattcctcgacgtcctcccccgtcggttacggggacaaacgcctacgccgtcgactacgtcgtacgtggtcgtcgcgacgtcgtaggacggacggaggtactacggtaacttacgttacgtacgtaccttacgttacgtttacggtttcggggggttgttcggtcgttcggtcgtcgttacgggttcgggacgggtacggtaccgtaacggtcgtcgtaaccgtacgttaacgtccgaccgaccgtacggttcccgttccggttccccgttcggtcctaaccgttccgtcccttcccctaacccttcccgttaacccg

SEQ ID NO: 359110 - DNA, 635 bp, Homo sapiens
  misc_feature: GZ8MTXP01D8K1D.17.33.C11.1.454.CMB.2.raw
  modified_base (148)..(148): a, c, t, g, unknown or other
  misc_feature (148)..(148): n is a, c, g, or t
  modified_base (177)..(177): a, c, t, g, unknown or other
  misc_feature (177)..(177): n is a, c, g, or t
  modified_base (188)..(188): a, c, t, g, unknown or other
  misc_feature (188)..(188): n is a, c, g, or t
  modified_base (592)..(592): a, c, t, g, unknown or other
  misc_feature (592)..(592): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggngtctggtcctacgctggtacgaaacccanacagacccctnacgctgacctgctaccttctctggcttctcactcaagaacgagtaggaagtggggagtgggctggactcccgcacgcccccgaggaaacggccctggagtggcttgccgctctagtttagttgggatggaagtaagtaagactaactactagtcccgtctactagaacgaacacggctaccaccataccaaccaacgaacccaccctaaccaacaaaccgtaggtcgtaccttaacactacgaacctaatacgtacggaccctggtacggaacacgacaccatatacgttaactcgttcgtacgtcttacgttagttcggggtttacggtagtttacttacgttcccttattcgtactcggtaagggtacgagggtacttcgtcggtccaccgttccttccgcnccgccctacccgaccggaacgggtccccttaacgtttccccgg

SEQ ID NO: 359111 - DNA, 584 bp, Homo sapiens
  misc_feature: GZ8MTXP01DZOZO.17.33.C11.1.454.CMB.2.raw
  modified_base (229)..(229): a, c, t, g, unknown or other
  misc_feature (229)..(229): n is a, c, g, or t
  modified_base (274)..(274): a, c, t, g, unknown or other
  misc_feature (274)..(274): n is a, c, g, or t
  modified_base (300)..(300): a, c, t, g, unknown or other
  misc_feature (300)..(300): n is a, c, g, or t
  modified_base (399)..(399): a, c, t, g, unknown or other
  misc_feature (399)..(399): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgattcaggagccctcactgactgtcgtccccagggaggacagtcactctcacctgtgcttccaacacgtggancagtcaccagtgtcttactataccaaatggttccagcagaaaccnggacaagcacccaggcactctattanaatacaaacaaacaaacactcctacggacccctcgcccgattctcacgcctccccctccgtggggacaaagctcgccctgacactcgtctggtgtcgcncgcgtgaggacgaggcgtagacgttatactcgcctacttcttacgtttggggtggttgtcgtgtgtcgttagtcgggacggtagggacaacgcgtgaaccgttcgttaagccgttacgcccgaacggttccgttccgccccgtcgtaccgtctccgtccggttcccctcccgttcccttaacccg

SEQ ID NO: 359112 - DNA, 645 bp, Homo sapiens
  misc_feature: GZ8MTXP01DS9JJ.17.33.C11.1.454.CMB.2.raw
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgcaccttctctggcttctcactcagaacgagtggaagtgggagtgggctggactccgtcacgaccccgaggaacggccgtggagtggcttgcgctctatttagtggatgagagcaagcactacngtccgtctntagaagacacgccctacacataccaaccgaaaacgaccaaccctaccaaaccgaaaccgtacggttaccggtaccttaaacaaactacgaaccctaaatacgtacggacccttagaccggaacacgacgacaactaacttacttacgtacgttcaacgttcttacgttaggttgggttaccgggtaattttacgttaccgtttccttacgtttcgaaccgttaacggtcgggggacctacggggttactcggttcgggacccttccggttctcccggactccgaccctccgaaccgtaaccgggcccgttaaccg

SEQ ID NO: 359113 - DNA, 638 bp, Homo sapiens
  misc_feature: GZ8MTXP01B1PRW.17.33.C11.1.454.CMB.2.raw
  modified_base (214)..(214): a, c, t, g, unknown or other
  misc_feature (214)..(214): n is a, c, g, or t
  modified_base (330)..(330): a, c, t, g, unknown or other
  misc_feature (330)..(330): n is a, c, g, or t
tcagcgtagactagcacgaccggtgctcgatttagagtgagctcgttgggtttgggggactcctgtgccccaccatggacacactttgctccacgctcctgcttctgaccatcccttcatgggtcttgtcccagatcaccttgaaggagtctggtcctacgctggtagaaacccacacagaccctcacgctgacctgccaccttctctgcttcncactcagaacgagtggaatgggagtgggctggatccgtcacgccccgaggaacgccgtggagtggctgcgctctatttagtggatgagagtagcactacagtccgtctcgtagaanaacagctacaccccatacaacgaacgaccaacctacccaacgaaaccgtggtacgttacctaacaactacgaacctaatcgacggaccctgtacggacaacacgacctaactattacttactgttaccacgggtcttcgttagttgggttacgggtatttacgtttacgttcccctttagttcgaaccgttacggtcggggaaccgtaagggggttaacctcggttacggtaccctcccggttccttcccgacgccgtcccctaacccgaacccggtacgggcccctaaggttccccggtttcccccg

SEQ ID NO: 359114 - DNA, 699 bp, Homo sapiens
  misc_feature: GZ8MTXP01BUON1.17.33.C11.1.454.CMB.2.raw
  modified_base (214)..(214): a, c, t, g, unknown or other
  misc_feature (214)..(214): n is a, c, g, or t
  modified_base (342)..(342): a, c, t, g, unknown or other
  misc_feature (342)..(342): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtctcgtcccagatcaccttgaaggagtctggtcctacgctggtacgaaacccacacagaccctcacgctgacctgcaccttctctgcttcncactcagaacgagtggaatggggagtgggctggactccgtcacgccccgaaggaacggccctggagtggcttgcgctctatttagtggatgagagtaagcactacagtccctctctagaacgtaacgngcctaccgaaccataccgaaaccgaacggtaaacccaaccctaaccaaaccgtaaaacccgtagggttaccgggtacccttaaacgtaactacgtaaaccctaaagtacgttacgggaccccgttaggtacggaaccacgaacgtaccaacctaattaacttacttcggttaccacgttccgttacgttaaggttcggggtttaccgggggtattttaacgtttaccgtccctttaacgttttcgaaccgttcgggtaacgggggtacccaggggtaaccttcggttcggtaccttacccgttccttaccgccacggtccctccgaacccgacggggtccccttaacgtttccccgg

SEQ ID NO: 359115 - DNA, 643 bp, Homo sapiens
  misc_feature: GZ8MTXP01BRP2R.17.33.C11.1.454.CMB.2.raw
  modified_base (280)..(280): a, c, t, g, unknown or other
  misc_feature (280)..(280): n is a, c, g, or t
  modified_base (611)..(611): a, c, t, g, unknown or other
  misc_feature (611)..(611): n is a, c, g, or t
tcagcgtagactagcacgaccggtgctcgatttagagtgagctcgttgggtttgggggactcctgtgccccaccatggacacactttgctccacgctcctgcttctgaccatcccttcatgggtcttgtcccagatcaccttgaaggagtctggtcctacgctggtacgaaacccacacagaccctcacgctgacctgccaccttctctgcttctcactcagaacgagtaggaagtgggagtgggctggactccggtcacgccccaggaaggcctggagnggcttgcgctcatttagtggatgagagtaagcactacagtccgtctctagaacgaacagcctacgaacccctataccaaccgaaacggacccaaaccccttacccaacgaaaacccgtagggttaccggttacccttaacaaacgtacgaaacccaattacgtcggaaccccttgacggacaacacaccactatacttactgttaccacgggtcttagttacggttagggttcggtaacgtttacgttacgttacccctttatttacggaccgttacggtggggcctaagggacttcgttggtcctaccggttcttcccgacaaccgtccnccaaccgacgggcccctaagttccggttcccc

SEQ ID NO: 359116 - DNA, 630 bp, Homo sapiens
  misc_feature: GZ8MTXP01EY22Y.17.33.C11.1.454.CMB.2.raw
  modified_base (273)..(273): a, c, t, g, unknown or other
  misc_feature (273)..(273): n is a, c, g, or t
  modified_base (298)..(298): a, c, t, g, unknown or other
  misc_feature (298)..(298): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggtaccagcaagaaaccnggacaagcaccaggcactcatttanataacaaacaaacaaacactcctcgacccctgcccgattctcacgcctcccccctcgttgggggacaaacgctacgccctgacactgtcgtggtgtgcagcctggacggacgaggctacgtacttaacgttactcgtaccttacttacttacgtttcgggggtggttgtcgttggtgtcgttacggttcgggaccggggtacgggaaccaaggtcgtcggtaaccgtttacgttaaacggtccgttaccgacccgaacggttccgttccgcccccgtaacggtccctaaccgttcccgttccgttaccccctaacccgttcccgttaacccg

SEQ ID NO: 359117 - DNA, 678 bp, Homo sapiens
  misc_feature: GZ8MTXP01DX3MJ.17.33.C11.1.454.CMB.2.raw
  modified_base (356)..(356): a, c, t, g, unknown or other
  misc_feature (356)..(356): n is a, c, g, or t
tcagcgtagactagcacgaccggtgctcgatttagagtgagctcgttgggtttgggggcgccaggggtcccttccaatatcagcaccatggcctggacccctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggtccagcaagaaacctggaacaagcacccgaggcactctaatttataacgtaaacaaaacaaacaaaacacctcctacggaaccccctgacccgtattccncgacggcctccccgttcccggttgggggacaaagcctcgacccctagaacgactggtcctggtcgtgccacgccgtaggacggacggacgggtcctaggtaacttagttactcgtaccttacttcgttacgtttgggttgggggtcgtcgttgtacggtcgttaacggttcgggcgggaaacgggaccaaggtcgtcggtaaccgttaacgtttaaacgccgaaccggacccgaaacggtcccgttccccggcccccgttccggtccctacccttcccgttccccggttcccccgaccccctttcccgttcccttaacccgg

SEQ ID NO: 359118 - DNA, 641 bp, Homo sapiens
  misc_feature: GZ8MTXP01A9U3S.17.33.C11.1.454.CMB.2.raw
  modified_base (306)..(306): a, c, t, g, unknown or other
  misc_feature (306)..(306): n is a, c, g, or t
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccagggaggacagtcactctcacctgtgcttccaacactggagcagtcaccagtgacttactataccaaactggtaccagcaagaaacctggaacaacgcaacccgaggacactctatttanagtaacaaacaacaaacactcctcggaccccngacctattcncacgtcctcccccgtcggttggggaccaaagcctacgccctgactacgtcgtcgtggtgtcgcgacgcgtaggaggacgagactagacttatactcgtaccttactcgttacggtttgggggttggtgtcctggtcgtcgttaggtcgggacgggtacgggaaccgtaacgtccgtcgtaacccggttacgttaacggtaccgaccgtaccccgtaacggttccccgttcccggttcccccgtcggtaccctaaccttccgttcccttaccccgtccccttaaccgttccccg

SEQ ID NO: 359119 - DNA, 656 bp, Homo sapiens
  misc_feature: GZ8MTXP01CP22Y.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcctaccttctctggtcttctcactcaagaacgagtaggaagtggggagtgggctggactccgacacggaccccgaaggaacggcccgtggagtggcttgcgctactagtttagtggatgaagaagtaagcactacgacgtcctctacgtagaaacgaacgaggacctacccaaccaactaccgaaacccgaaacggaacccaaccctaaccaaaccaaaccgtaggttacgtacctaacgaatacgaacctaagtacgtaccggacctaggtacgaacacgacacccaataacttacttacgtacgttaccacgttccgttagtaggttggggttacgggtatttacgttaaccgttcccttagttacgacgtaacggcgggaccgagggtaccttcgtcggtacttcccgttcttaccggcaccgtcccaccgaccgacggtcccaacgttccccg

SEQ ID NO: 359120 - DNA, 743 bp, Homo sapiens
  misc_feature: GZ8MTXP01CBG5A.17.33.C11.1.454.CMB.2.raw
  modified_base (355)..(355): a, c, t, g, unknown or other
  misc_feature (355)..(355): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacacgacccctcacgctgacctgcctaccttctctggcttctcactcaagaacgaggtaggaagtggggagtgggctggactccgcacgaccccgaggaacgccgtggagtgcttcgctctctagtttagtggatggagagtaacgcactacgtacgtccgtctacgtagaagaacgngcctacccaccactaccgaaaccgaacggaaacccaacccgtaacccaaaccgtaaaccgtacgggttacgtaccttaaacgaaacgtacgaaaccctaaatacggtaccggtaacccttaggaccgaaaccaccgaacgaacctaacttaacttaacgttactacgttacgtacccggtgtttaccgttagggtttaccgggggttacgggttaactttacgtttacccgtttacccgttaacgttttacggacccggtacgggttaaccggggtaaccgttagggtaacccgttcggtaccggtacccgttacccgttcccgttacccgtaaccgaccggtcccctaccggacccggaacgggtcccccgttaagtttccccccgg

SEQ ID NO: 359121 - DNA, 625 bp, Homo sapiens
  misc_feature: GZ8MTXP01EGV4L.17.33.C11.1.454.CMB.2.raw
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (416)..(416): a, c, t, g, unknown or other
  misc_feature (416)..(416): n is a, c, g, or t
  modified_base (582)..(582): a, c, t, g, unknown or other
  misc_feature (582)..(582): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcacctgtgccttaccaacactggagcagtcaccngtncttatataccaaactggtccagcaagaacnggacagcaccaggcactctatttatataacaaaacaaacaaacacctaccgtacggaccccctcgacccgtattcctcacggtcctcccccgtccgtggggacaaagctcgaccctgactactcgtcgtggtgtcgacacgtccgnggaggacgagggtctagtacttatctacgccttaacttcttacgtttggggttgtgtacttggtcgtcgttcgttcgggacgggaacgggacaacggtcgtacgtaaccgtacgttaaacgtccgaacgtacccgtaaggcccgttccgttcccccgttggtcccnccgtttccgtcccggttcccctaaccccgttccctttaacccg

SEQ ID NO: 359122 - DNA, 618 bp, Homo sapiens
  misc_feature: GZ8MTXP01D9VA9.17.33.C11.1.454.CMB.2.raw
  modified_base (269)..(269): a, c, t, g, unknown or other
  misc_feature (269)..(269): n is a, c, g, or t
  modified_base (294)..(294): a, c, t, g, unknown or other
  misc_feature (294)..(294): n is a, c, g, or t
  modified_base (421)..(421): a, c, t, g, unknown or other
  misc_feature (421)..(421): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaacnggacaagcaccaggcactcatttanagtacaaacaacaaacactcctggacccctgcccgattctcacggcctccccctccgttgggggacaaagctacgccctgacactgtctgggtgtgcagcctggaggacgaggctagacttattacncgtcctacttcttacgtttgggggtggttgtcttgtcgtcgtagttcgggacgggaacgggtacccaaaggtccgtacggtaacccgttacgttaagtccgttaacggccccgtaaagggttccttcccggccccccgttcgggtccctaaccttcccgttcccggttccccctaaccccctttcccgttaaccccg

SEQ ID NO: 359123 - DNA, 752 bp, Homo sapiens
  misc_feature: GZ8MTXP01ADHGQ.17.33.C11.1.454.CMB.2.raw
  modified_base (216)..(216): a, c, t, g, unknown or other
  misc_feature (216)..(216): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgccaccttctctggcttcncactcagaacgagtggaagtgggagtgggctggactccgcgacgcccccgaaggaacggccgtggagtggcttgcgtctctagtttagtggataggagagtaacgctaactacgagttcccgtctacgtagaaacgaacacggtcctacccaacctatacccgaaccgaacggaaacccaccctaacccaaacgaaacccgtagggttaccgtaaccctttaacgaaacgtaccgtaaaaccctaaagtttaccgaccgggtaaccccgttaggacggaaaccaacgaccgtacccaattattaaacttctacgtttacaacgtcttacgttaacggttggggttaacgggtattttaacgtttaccgttaaccctttcggtttacgaccggttacgggtaaccggggttaccaacggggttaacccttggttaacccgggtccttaccccggtttccgttaaccccggcctacccgggtccccttaacccgggaaaccccggaacccggggtcccccttccgggtttccccccgg

SEQ ID NO: 359124 - DNA, 749 bp, Homo sapiens
  misc_feature: GZ8MTXP01D0O6U.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggaggacagtcactctcacctgtcgcttccaacactggagcagtcaccagtgacttactataccaaactggtccagcaagaaacctggacaacgccaacccgaggccactactaatttaataacgtaaaccaaaacaaaccaaacgtacctaccgtacggaccccctcgacccgtatttccacgacggtcccttcccccccgtccggttagggggacctaaaacggcccttaaccgacccctggtaaacctcgttcggttccgtgggtcgtacgaccgtaacgccgtaggaacgggacgacgggtcctacggaacctttagttactacggtacccttaacgttccgtttaacgtttgggggtggttaccgtcgttaggtcgtcggttaagtttccgggacggggtacggtaacccgtaaaggtccgtaacgtaacccgtttaacgttaaacgggtcccaaccggaacccgtaaccggttccgttccccggttccccccgttccgggtaaccctccctttaccggtccccttaccccctcccccgtttcccgtttaaccccg

SEQ ID NO: 359125 - DNA, 740 bp, Homo sapiens
  misc_feature: GZ8MTXP01ELW8M.17.33.C11.1.454.CMB.2.raw
  modified_base (332)..(332): a, c, t, g, unknown or other
  misc_feature (332)..(332): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaatggggagtgggctggactccgtcacgacccccgaggaaacggccctggagtggcttgcgctctatttagtgggatggagagtaagcactacagtcccgtntctagaagaacgaggcctaccaccataccaaccgaacggaacccaaccctcccaaaccgtaaacccgagggttaccggttaacccttaacaaacttacgaaaccctaaattacgtacgggaaccctggtacggaaccacgaacgacccaactaacttaacgtttaacttcggtttaccaaccgttcgtttacgttaacgggtttgggggtttaccgggggtaatttttaacgtttaacccggttacccctttaacgttttacgaaccgttaacgggtaacgggggtacccgttaaagggggtaaccctttcggtacgggtacccttacccggttccgttcccggaaccgtaccgtccccgttacccgaacccgggttaaccgggtccccttaacggtttccccccggg

SEQ ID NO: 359126 - DNA, 564 bp, Homo sapiens
  misc_feature: GZ8MTXP01A52ZD.17.33.C11.1.454.CMB.2.raw
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (493)..(493): a, c, t, g, unknown or other
  misc_feature (493)..(493): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaatggttcagcanaacngacagcaccaggcacncattatagtaacaaacaacaaacactcctacggaccccctgccccgtattcctacaggcctccccccgtccgttgggggacaaacgctacgccctcgacacgtgtctggtgtgcagcctggaggcgaggctagacttattactgccactttttctacgtttgggggtagtgtctgtgcgtagttcgggcggaggtaccaagctgaaccgtnttagtcagtcccaaggccgttccgacccctcggtactccgtctccgttcccctaacccttccgttaacccg

SEQ ID NO: 359127 - DNA, 655 bp, Homo sapiens
  misc_feature: GZ8MTXP01BJ9RL.17.33.C11.1.454.CMB.2.raw
  modified_base (340)..(340): a, c, t, g, unknown or other
  misc_feature (340)..(340): n is a, c, g, or t
  modified_base (618)..(618): a, c, t, g, unknown or other
  misc_feature (618)..(618): n is a, c, g, or t
tcagcgtagactagcacgaccggtgctcgatttagagtgagctcgttgggtttgggggactcctgtgccccaccatggacacactttgctccacactcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatcccgtcacgcccccgaggaaacggccctggagtggcttgcgctctatttagttgggatgagagtaagcactacagtccgtctctagaagaacnggctaccaccataccaacccaacggaacccaccctccgaaaccaaacccgagggtcgaacttacccttaacaaactacgaaccctaaattacgtcgggtacccctggtacggacaccgacgacccaactaattaactttaccttgggtttcctaacggtccttacgttaggttcggggtttaccggggttaagttttaacgtttacggttaccctttacgtttcgaccgttaacggtcggggacgtacgggttaacgttcgtcggttccgccgttccnccgcaacgtccctccgacccgaacgggccctaaccgg

SEQ ID NO: 359128 - DNA, 637 bp, Homo sapiens
  misc_feature: GZ8MTXP01DIUMD.17.33.C11.1.454.CMB.2.raw
  modified_base (329)..(329): a, c, t, g, unknown or other
  misc_feature (329)..(329): n is a, c, g, or t
  modified_base (625)..(625): a, c, t, g, unknown or other
  misc_feature (625)..(625): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaacggccctggagtggcttgcgtctctatttagttggatgagagtaagcactacacgtcccgtcnctagaacgaacaggcctcccaccacgtacaaccgaacggaacccaaccctcccgaaacgaaacccgtagggttacgttacccttaacaaactacgaacaaattactacgggaccctggtacgaacacagacccataactattacttgttaccacgtcttacttagtggtttaccgggtatttacttaacggttcccctttagtttacgacgttacggttgggggaccaggggtaaccttcgtcgggtccttaccggttccttaccggcacgtcccgtacccaccggacggtccccnggtttcccccgg

SEQ ID NO: 359129 - DNA, 609 bp, Homo sapiens
  misc_feature: GZ8MTXP01BGEN0.17.33.C11.1.454.CMB.2.raw
  modified_base (528)..(528): a, c, t, g, unknown or other
  misc_feature (528)..(528): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcacgccccgaggaacggccctggagtggcttgcgctcatttagtggatgagagtaagcactacagtccgtctcgtagaagaacacggctccaccataccgaaccaacggaaccaaccctccaaacaaacccgtagggtcggtaccttaacgaatacgaaccaatacgtcggaccctaggtcggaacacgagacccaatacttacttactcgttacacggtcttacgtagttcggggttcgggtattacgttacgtcccttagtttcgacttacggnggggtaccagggtaacttcgtcggtccaccggttcttccgctacgccctaccgaccgttaacgggtccccaagttccccgg

SEQ ID NO: 359130 - DNA, 617 bp, Homo sapiens
  misc_feature: GZ8MTXP01C7BWL.17.33.C11.1.454.CMB.2.raw
  modified_base (286)..(286): a, c, t, g, unknown or other
  misc_feature (286)..(286): n is a, c, g, or t
  modified_base (456)..(456): a, c, t, g, unknown or other
  misc_feature (456)..(456): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcacgccccaggaaggccctggagtggcttgcgtntcatttatggatgagagtaagcactacagtccgtctacgtgaagacaggcctaccaccatcaaccaaggaacccacctccaacaaacccgaggtacgtacctaacaatacgaacctaatacgtacgaccctgtacggaacacacgacccaatatagttactgttcaacgnttctagtgggttcgggtatttacgttacgtccctttaacgttcgtaaccgtacgttcggggacagggggtaaaccttcgttcgggtccacccgggtttcccgttcccgccgtaccgtcccctaacccgaccggttaaccggtccccgttaaccggttcccg

SEQ ID NO: 359131 - DNA, 652 bp, Homo sapiens
  misc_feature: GZ8MTXP01CXI2I.17.33.C11.1.454.CMB.2.raw
  modified_base (217)..(217): a, c, t, g, unknown or other
  misc_feature (217)..(217): n is a, c, g, or t
  modified_base (330)..(330): a, c, t, g, unknown or other
  misc_feature (330)..(330): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagacccctcacgctgacctgcctaccttctctgcttcncactcagaacgagtggaagtggggagtgggctggactccggtcacgccccgaaggaacggccgtggagtggcttgcgtctactatttagttggatgagagtacgactactacngtcccgtctacgtagaacgaacgacggcctacccaaccacgtaccaaccgaacgaaacccaccgtaaccaaaccgaaaccgtagggtacgtaccttaacaatacgaacaatagacgaccgtggacgacaacgtacgaccaaactattaacgttactcgttaccgacgtcgttacgttaagggtcgggtttaacgggtagttttacgttacgttacccttagtttacgaaacgttccgggtaaggggacgttaacgggttacttcgtacgggtcacccgttcgaccgcacgtcccgaccgaccgacgtcccgaacgttccccg

SEQ ID NO: 359132 - DNA, 641 bp, Homo sapiens
  misc_feature: GZ8MTXP01CT63M.17.33.C11.1.454.CMB.2.raw
  modified_base (271)..(271): a, c, t, g, unknown or other
  misc_feature (271)..(271): n is a, c, g, or t
  modified_base (438)..(438): a, c, t, g, unknown or other
  misc_feature (438)..(438): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactggtccagcagaaaccngacaacgcacccagggccactatatttatacgtaacaaacaacaaaccactacctcggaccccctgcccgtattcctcacggcctccccccgtccggttgggggacaaagcctcgccctgactactgtcgtggtgtgcagctggaggacgaggctagtacttatacncgtacctactacttacgtttggggtggttcgtcgttgtcgtcgttacggttcgggtacggggacgggtaccgaagtccgtcggtaacccgttacgttaacggtccgaccgtaccccgaacgggttcccgttccggttccccccgtcgggttaccctccgttcccgttcccggttcccccggtccccttaaccccgtttccccg

SEQ ID NO: 359133 - DNA, 681 bp, Homo sapiens
  misc_feature: GZ8MTXP01APSA4.17.33.C11.1.454.CMB.2.raw
  modified_base (328)..(328): a, c, t, g, unknown or other
  misc_feature (328)..(328): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtgggagtgggctggatccgtcagccccgaggaaacggccctggagtggcttgcgctctatttagttggatgagtagtaagacactacagtcccgtntcgtagaagacacggctccaccactaccaacccgaaacggaaccaaccctcccaaaccgaaaacccgtacggggtacggttaccctttaacaaacttacggaaccctaaagttaacgtacgggacccccttaggtacgggaaccaaccaacgaccctaacctaagttactttaacgtcgttacaacggtctttcgtaaggttcgggttcgggggtatttacttacggttccctactttacggacttacgtcgggggcccttaaagggggtccttacggtcggtaccttaccggttccttacccggcaccgtaacccctccgaaacccgttacgggtccccaagtttcccccgg

SEQ ID NO: 359134 - DNA, 616 bp, Homo sapiens
  misc_feature: GZ8MTXP01A2WUT.17.33.C11.1.454.CMB.2.raw
  modified_base (229)..(229): a, c, t, g, unknown or other
  misc_feature (229)..(229): n is a, c, g, or t
  modified_base (277)..(277): a, c, t, g, unknown or other
  misc_feature (277)..(277): n is a, c, g, or t
  modified_base (347)..(347): a, c, t, g, unknown or other
  misc_feature (347)..(347): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccgagggaggacagtcactctcactgtgcttccaacacgtggancagtcaccagtgcttactactaccaaactcggtccagacaacgaaccnggaacaacgcaccgaggcactctattataagtaacaaacaacaaacactccgtacgaccctcgcctatcncacgcctccccgtcgtgggacaacgctcgcctgactacgtgtcgtggtcgtgacacgcgtaggacggacgaggtctacgtacttaattaccgtgtaccttacgttcgtttacgtttgggggtcggtcgtgttcggtgtccgttaacggttccgggacggtacggtaaccgtaggtcctacggtaaccgttaacgttacgtacacggacccgaaggttccttcccgttcccgtcggtctccttcgtcccgttccttccccgttcttcccg

SEQ ID NO: 359135 - DNA, 821 bp, Homo sapiens
  misc_feature: GZ8MTXP01DIUDM.17.33.C11.1.454.CMB.2.raw
  modified_base (301)..(301): a, c, t, g, unknown or other
  misc_feature (301)..(301): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccgaggagggacagtcactctcacctgtgcttaccaacactggagcagtcaccagtgtcttactactaccaaactggttccagcaacgaaacgtggacaagccacccgaggcactntatttatagtaacaaacaacaaacactaccgtcggacccctacgcccgtacttctacacggcccttcccccccgttcccggttacggggggacctaaaacggccgttaacccgggccccttcggaacctacccgttcggtaccgttgggttggttcggccgtaacggtccgttacgggaacggggtaaccggacgggtacgtacgggtaaaccgtttaactttacgttaccgtaccccttaaccgtttaccgtttaaccggttttggggggtttcgggtcgttaccgttcggttacgtccgtttaacgggtttcggggaaccggggtaacggggaacccgtaaacgggtccgtaaccggtaacccggtttacgtttaaaccggttacccgaaacccgggtaccccgtaaaccgggttcccgttcccggttccccccccggtttaacgggttacccctaacccgttttccccggtcccggttttacccccccggtccccgtttaaccccttttcccccggg

SEQ ID NO: 359136 - DNA, 648 bp, Homo sapiens
  misc_feature: GZ8MTXP01CG90F.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtcgaaacccacacagaccctcacgctgacctgccaccttctctgcttctcactcagaacgagtggaatgggagtgggctggactccgcacgccccgaggaacggcccgtggagtggcttgcgtctctatttagtggatgagagtaagcactacacgttccgtctacgtagaaagaaacgagtctaccccaaccactaccgaaccgaaacggaaacccaacccgtaacccaaacaaacccgtagggtcgtaaccctaacgaaactacgaaacctaagttacgacggtaccccgtgtacggaccacacgaccctaatacttaacttacgttcgttaccacgttcttcgttaacgtggggtttacgggtatttacgtttacgtcccttagttgaccgtaggtcgggaccgttagggtaccttcgtacgtccaccggttccttcccgctaccgcccctaccgacggaccggtcccgttaagtccccg

SEQ ID NO: 359137 - DNA, 859 bp, Homo sapiens
  misc_feature: GZ8MTXP01BV5DF.17.33.C11.1.454.CMB.2.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtcgcttccaacacgtggagcagtcaccagtgcttactatacccaaactcggttaccagacaacgaaaccgtggaacaacgccaacccgagggaccactactaatttaataacgtaacaaaacaaacaaaacctacctacccgttacggaccccctcggacccctatttccacgacgggtcccttaccccccccgttccgggtttacggggggaacctaaaacggtcccgtaaccgtaccccgttaacgggaaaccctaaacgttccggtttacgttccggggtaggttccgaccaacggtcccgttagggaaacgggtaaccgggaaggtacgttaacggtaaaccgtttaactttaccgtaccggttacccgtttaaactttccgtttaaccggtttttggggggttggttcggtccgtttgggttcggttaccgtttaacgggtttcccgggggaaccggggttaaacggggaacccgtaaacggtccggttaccggtaaacccggtttaacgttttaaacggtaccccgacggtaaaccccgaacgggttccccgttacccggttccccccgttaacgggttaccctaacccgtttcccggttaccccgttaacccccttcccccgtttccgtttaacccccgg

SEQ ID NO: 359138 - DNA, 783 bp, Homo sapiens
  misc_feature: GZ8MTXP01BVULF.17.33.C11.1.454.CMB.2.raw
  modified_base (213)..(213): a, c, t, g, unknown or other
  misc_feature (213)..(213): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttcncactcagaacgagtggaagtggggagtggggctgggactccggtcacgacccccgaaggaacggcccgtaggagtggcttgcgtctcatttagtgggatgaagagtaacgcactacgcgtcccgtctacgtaggaaacgaacgacggctaccccaacctactaccgaacccgaacggaaacccaaccctaacccaaaccgaaacccgtacgggttaccgtaacccttaacgaaacgtacgaaaccctaaagttaccggtaccggtacccgtaggtacggaaacccaccgaacgacccctaataactttaactttaccgttacggtttacccgaacggtcctttaccggttaggtttcgggggtttaccgggttaagtttaacgtttaccggttaccccctttaaagtttccggtaacccggttacgggtaaccgggggtaaccgttaaacgggggtaaccctttcgggttaacccgggtcccttaccccggttcccgttccccggccgttaacccgccccgttaaccccggaccggttaaacccgggtccccttaacggtttccccccgg

SEQ ID NO: 359139 - DNA, 719 bp, Homo sapiens
  misc_feature: GZ8MTXP01EF3ZH.17.33.C11.1.454.CMB.2.raw
  modified_base (322)..(322): a, c, t, g, unknown or other
  misc_feature (322)..(322): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctggcttctcactcagaacgagtggaatgggagtgggctggatccgtcacgccccaggaacgcctggagtggcttgcgctctattagtgggatgagagtaagcactacagtcccgtntcgtagaacgaactaggcctacccaaccataccaaacccgaaacggaaacccaacccctaaccgaaacctaaaacccgagggttccggttaacccttaaacaaagttacgaaaccctaaagttacgtacgggacccttaggtacggaaccaacgacgacccaactaagttaacttaccgttacgttaccacggttactttacgttaacgggttcgggggttaaccgggggtaattttacgtttaacggttccccttagtttacgtaccgttacggtcgggggtacccttaagggggtaaccttccggtacggttcccgacccggttccgttcccgggaactaccggtccccttaccccggaacccgaaccggggtccccttaacggtttcccccggg

SEQ ID NO: 359140 - DNA, 619 bp, Homo sapiens
  misc_feature: GZ8MTXP01ATAQE.17.33.C11.1.454.CMB.2.raw
  modified_base (334)..(334): a, c, t, g, unknown or other
  misc_feature (334)..(334): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccggtcacgcccccgaggaaacggccctggagtggcttgcgctcatttagtggatgagagtaagcactacagtccgtctctagaanaacaggctaccaccatacaaccaacggaaaccaccctccaaacaaaccagggtcgtccttaacaaatacgaacccaatacgtcggaccctagtcggaacacgacgaccaactatacttaactgttcacgtctacgttagttcgggttcgggtaagttacttacggtcccttaagtttcgacgttacggtcggggtaccagggggtaaccttcgtacgggtccttacccgggttccacccggtcacgtccccgtaccgacccgaacgggccccaacgtttccccgg

SEQ ID NO: 359141 - DNA, 614 bp, Homo sapiens
  misc_feature: GZ8MTXP01A1QAP.17.33.C11.1.454.CMB.2.raw
  modified_base (605)..(605): a, c, t, g, unknown or other
  misc_feature (605)..(605): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtgggagtgggctggatccgtcacgccccaggaaaggcccgtggagtggcttgcgctctagtttagtgggatggaggagtaagacactacgtacgtcccgtctacgtagaaacgaacaggctaccaccataccaaccgaaacgaaaccaccctccaaaccaaaccgtagggtacgtaccttaacaatacgaaccaatacgacggacctggtacgacacgacgaccatatattactgttacacgtctacttagttggggttacgggagtttacgttacgttcccttaacgtttgaacgtacggtggggcccgaggggtaccttcgtacgggtccaccggttcttaccggctaccgcctaccaccggacggtcccngtttccccg

SEQ ID NO: 359142 - DNA, 576 bp, Homo sapiens
  misc_feature: GZ8MTXP01CN8DF.17.33.C11.1.454.CMB.2.raw
  modified_base (264)..(264): a, c, t, g, unknown or other
  misc_feature (264)..(264): n is a, c, g, or t
  modified_base (337)..(337): a, c, t, g, unknown or other
  misc_feature (337)..(337): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtcgtcccaggaggacagtcactctcacctgtgcttccaacactggagcagtcaccagtgcttactactccaaactggttccngcagaaacctggacaagcaccagggcactcatttatagtacaaacaacaaacactcctcgaccctgccattcncacgctcctcgttggggcaaaagctcgccctgacactgtctggtgtgtcagtccgtggaggacggaggctgacttattactcgtaccttacttcgttacgtttcgggttggtcgtcgttgtgtcgttacgttcggggtcggacgggaccgaagtcgtgaccggttacttacgtcgacgcccgaacgggcctccgccccgttcgggtcctaccttcctccggtttccccgttaacccccg

SEQ ID NO: 359143 - DNA, 808 bp, Homo sapiens
  misc_feature: GZ8MTXP01DINFV.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaatgggagtgggctggactccgtcacgccccaggaagccctggagtgcttgcgtctctatttagtggatgagagtaagctactacgagtccgtctactagaaagtaacaggcctaccaaccataccaaaccgaaacggaaaccctaaccctaacccaaaccgtaaaacccgtacgggttacggttaccccttaaacgtaaacgttacggaaaccctaaagttaacgtcgggtaaacccctggttaacgggaaaccaacgaacggaaccctaaactaactttaactttaaaccgttcggtttaaccgaccgttccgtttaaccgttaggtttacgggggtttacgggggttaacgttttaaccgtttaaccgggtttacccctttaaacggtttttacggaacccgttaacggggttcggggggtaaccccttaaagggggttaaacccttccgggtttccgggtaccccgttaaccccgggtttcccgaaccccgggttaaccccaaaccggtcccccgttaaccccgtaaccgggaaaccccgggggtccccgttaaacggttttcccccccggggg

SEQ ID NO: 359144 - DNA, 739 bp, Homo sapiens
  misc_feature: GZ8MTXP01ATABG.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcacgccccgaggaacggccctggagtggcttgcgctctatttagtggatggagagtaacgctaactacgacgtccgtctacgtagaaacgaacgacggcctaccaccactaccaacccgaaacggaaacccaaccctaacccaaaccgtaaaacccgtaggggttaccgtaaccctttaacgaaacttacgaaaccctaaattacgtacgggtaccctaggtacggaaccacgaacgacccaactaacttaactttacgttacgttaccgaccggttactttacgttaacggtttcgggggtttaaccggggtagttttaacgtttaaccgttcccgtttaacgtttcggtaaccgttaccgggtaacgggggtacccgttaaggggaaccctttcggtaccgggtcccttacccggttccttcccgggtaacaccggtcccctacccggaacccggaaccgggtccccttaacggtttcccccggg

SEQ ID NO: 359145 - DNA, 530 bp, Homo sapiens
  misc_feature: GZ8MTXP01D8EE5.17.33.C11.1.454.CMB.2.raw
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttatggatgagagtaagcactacagtcccgtctctgaagaacaggctccaccatcaccaaggaacacctcacaaaccagtgtcctacatgacaatatgaccctgtgacacagccacatattactgttcacgtctctatgggttcgggattattaagtcccttatttcgactactggggtccaggggtaacttgtcggtcaccggttcttccgcagccctccaccagggtcccaagttcccgg

SEQ ID NO: 359146 - DNA, 651 bp, Homo sapiens
  misc_feature: GZ8MTXP01AV57S.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccggcacgccccaggaacgcctggagtggcttgcgctcatttagtggatgagagtaagcactacagtccgtctcgtagaagaacaggctccaccataccaacccaaacggaaaccaccctccaaaccaaaccgtacgggtacgtaccttaacaaatcgaaaccaatatcggaccctgtacggaacacacgaccactattaacgttacttacgttaccaacgtcttacttaaggttcgggttacggggtacgttttaagtttaaccggttccctttaacgtttcggtaaccgttacgggttaacgggggaccgttagggggtaaaccttcggttacgggtcccttacccggttcttcccggcgacgtcccctcgaacccgacgggtccccttaacgttccccgg

SEQ ID NO: 359147 - DNA, 671 bp, Homo sapiens
  misc_feature: GZ8MTXP01B9Z0Y.17.33.C11.1.454.CMB.2.raw
  modified_base (618)..(618): a, c, t, g, unknown or other
  misc_feature (618)..(618): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagacgagtggaatgggagtgggctggactccgcacgcccccgaaggaacggccctggagtggcttgcgctctatttagtggatgagagtaagcactacacgtccgtctcgtagaagaacaggcctaccaccataccgaaccaacggaacccaccctaaccgaaacctaaacccgtagggttacggtacccttaacgaaacttacgaaacctaaagtacgtacggacccttggacggaaccacgacgtacccaactacttacttactacggtttccaacggttctttacgtagtttcggggttaccggggtatttacgttacggttccctttaagtttcgaccgttcggtaacggggccgttaacggggtaaccttcgtcgggtccttacccgggttcccncccgccgtaccgtccccgtacccgaccgaccggtccccgttaacggttccccg

SEQ ID NO: 359148 - DNA, 735 bp, Homo sapiens
  misc_feature: GZ8MTXP01DWXJT.17.33.C11.1.454.CMB.2.raw
  modified_base (233)..(233): a, c, t, g, unknown or other
  misc_feature (233)..(233): n is a, c, g, or t
  modified_base (290)..(290): a, c, t, g, unknown or other
  misc_feature (290)..(290): n is a, c, g, or t
  modified_base (329)..(329): a, c, t, g, unknown or other
  misc_feature (329)..(329): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccgagggaggacagtcactctcacctgtcgcttaccaacacgtggancagtcacctagtcgtacttactactaccaaacgtcggtaccagacaaacgaaaccgnggaacaacgaccaacccgaggacctactactaatttaanaacgtaaacaaaacaaaccaaactacctaccgtacggacccctcgacccgtattccacgacgtacctcccccgtccggttacggggacaaacgtcctaaccgccctgacctacgtcgtcgtggtacgtgaccacgtcctacggagggacgacggtctacggtacttacgtaccgtcgtaccttacttacgttacgtttgggggtcggtcgtcgttcggtcgtaccgttacgggttcgggaccggggtaacgggaccgtaacggtccgttaccggtaaccgtttacgttacgaccgttaccggaccccgtaacgggttccccttcccggttaccccccggttcgggtccccttaacccgtttccccggttccccgttaccccctccccgtttccccgttaaccccgg

SEQ ID NO: 359149 - DNA, 542 bp, Homo sapiens
  misc_feature: GZ8MTXP01CE3LH.17.33.C11.1.454.CMB.2.raw
  modified_base (271)..(271): a, c, t, g, unknown or other
  misc_feature (271)..(271): n is a, c, g, or t
  modified_base (492)..(492): a, c, t, g, unknown or other
  misc_feature (492)..(492): n is a, c, g, or t
  modified_base (517)..(517): a, c, t, g, unknown or other
  misc_feature (517)..(517): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccnggacaagcacccagggcactcatttatagtacaaacaacaaacactcctggaccccctgccccgattctcacggctcccccctccgttgggggcaaacgctagcccctgacactgtctggtgtgcagcctggagggacgaggctgacttattactgcctactctacgtttggggtggtgctgtgctagtcggcggagggccaagctgaaccgtcttaagcngacccagccgttcgcccctcggtcnctctcgttccctcccgttcctcccg

SEQ ID NO: 359150 - DNA, 655 bp, Homo sapiens
  misc_feature: GZ8MTXP01D82RI.17.33.C11.1.454.CMB.2.raw
  modified_base (232)..(232): a, c, t, g, unknown or other
  misc_feature (232)..(232): n is a, c, g, or t
  modified_base (288)..(288): a, c, t, g, unknown or other
  misc_feature (288)..(288): n is a, c, g, or t
  modified_base (319)..(319): a, c, t, g, unknown or other
  misc_feature (319)..(319): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtcccgagggaggacagtcactctcacctgtcgcttaccaacacgtggancagtccaccagtcgtacttaactactacccaaagtcggttaccagcaacgaaaccnggaacaagccaccgaggcactactatttaanagtaacaaaacaaacaaacactccgtacgacccctgacccgtattccacacggtcctacccccgtccggttacgggggacaaacggtccgtaccgccctcgacctacgttcggtctgggtcgtcgcgacgacgtggacggacgaaggtctagtaacttacttacgcgtacctacttacgtttacgtttgggggtggtcgtcgttggtacgtcgtcggtcgggtacggacggtaacaacggtctacggaaccttcgttacgacttacgaccgtaacggccgttccgttccccgtcgtacctcctcctcccgttacccctaacccgttccttaacccg

SEQ ID NO: 359151 - DNA, 620 bp, Homo sapiens
  misc_feature: GZ8MTXP01EIPJH.17.33.C11.1.454.CMB.2.raw
  modified_base (168)..(168): a, c, t, g, unknown or other
  misc_feature (168)..(168): n is a, c, g, or t
  modified_base (186)..(186): a, c, t, g, unknown or other
  misc_feature (186)..(186): n is a, c, g, or t
  modified_base (592)..(592): a, c, t, g, unknown or other
  misc_feature (592)..(592): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtanaaacccacacagaccctnacgctgacctgctaccttctctgcttctcactcagaacgagtggaagtgggagtgggctggactccgtcacgcccccgaaggaaacggccctggagtggcttgcgctctagtttagttggataggagaagtaagcaactactagtcccgtctacgtagaagaacacggctacccaccataccaaccaaacgaacccaacctcccaaacaaaccgaggtacgtaccttaacaatacgaaccaaatactaggacccttagacggaacacgacgacaacataacgttacttacgttcaacgtctagttacgtgggtttaccgggtaagtttacgttaacgttcccttaagttacgacgttacggtcgggacgaagggtacttcgtacggtccaccgttcttccgcgacncccgtccacgacggtcccaacgttcccg

SEQ ID NO: 359152 - DNA, 703 bp, Homo sapiens
  misc_feature: GZ8MTXP01EHJF1.17.33.C11.1.454.CMB.2.raw
  modified_base (326)..(326): a, c, t, g, unknown or other
  misc_feature (326)..(326): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcagcccccaggaaacggccctggagtggcttgcgctctatttagtgggatgagagtaagcactacagtcccgtntctagaagaacaggcctaccaccatacaaccaacggaaccacctccaaacaaacccgaggttacggtacccttaacaattacgaaccctaaatacgtacgggtaacccctggtacggaaccacaacggcccctaaataacttaacggtttaacttcgggtttaccctaaaccggttccgtttaaccgttaggttacgggggttttacccgggggtaaatttttaccgttaaaccggtttcccccttaaagtttttcggaaccgtttacggtcgggggtacccttaaagggggtaaccttccggttacgggtccttacccgttcgttacccgcaccggtccctacccgaccgaaccgggtcccttaagtttcccccgg

SEQ ID NO: 359153 - DNA, 568 bp, Homo sapiens
  misc_feature: GZ8MTXP01EAHPC.17.33.C11.1.454.CMB.2.raw
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
  modified_base (341)..(341): a, c, t, g, unknown or other
  misc_feature (341)..(341): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaaaccnggacaagcacccaggcactcatttanagtaacaaacaacaaacactcctggacccctgccccgtattccncaggcctccccctcgttggggcaaagcctcgccctgacactgtctggtgtagcagctggaggacgaggctagactattactgtctactcttactttgggggtggtgtcttgtgtctacgttcggacgggtaggaccaacgcgtcgaaccgttcttagtccgttacgcccgaaggcttccgccccgtcggtcaaccgttcctccgttcccgtccccttccttaacccg

SEQ ID NO: 359154 - DNA, 671 bp, Homo sapiens
  misc_feature: GZ8MTXP01DX0I7.17.33.C11.1.454.CMB.2.raw
  modified_base (633)..(633): a, c, t, g, unknown or other
  misc_feature (633)..(633): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagacccctcacgctcgacctgcctaccttctctggcttctcactcaagaacgagtggaagtgggagtgggctggactccgcacgccccaggaacgcctggagtggcttgcgctctagtttagtgggataggagtagtaacgctactacgtacgttcccgtactacgtagaaacgaacgacggacctacccaccactaccaacccgaaacgtaacccaccctccgaaacaaaccgtaggttacgtacccttaacaaagtacgaacctaagttacgacgggtaacccttgggaccaacgacacacccactaattacttaacttcggttacaacgttcgttaccgttagttacggggttaccggggttagtttaactttaccggttaccctttacgtttacgaaccgtcggttggggacccgttaggggtaaccttcgtcgggtaccacccggttccncgcctacgccaaccgacggaccggtcccttcggtcccg

SEQ ID NO: 359155 - DNA, 676 bp, Homo sapiens
  misc_feature: GZ8MTXP01BA7RD.17.33.C11.1.454.CMB.2.raw
  modified_base (274)..(274): a, c, t, g, unknown or other
  misc_feature (274)..(274): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
  modified_base (400)..(400): a, c, t, g, unknown or other
  misc_feature (400)..(400): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgtcttactataccaaactggttccagcaagaaaccnggacaagcaccgaggcactntaatttanagtaacaaacaacaaacactcctcggacccctgcctattcncacggcctcccccgtcgttaggggacaagcctaacgccctgaccactgtcgtgggtntcgcacgtccgtaggacgggacggacggtctacggtaacttattaaccgcgtaccttacgttcgtttacgtttcggggggtggttgtcgttcggttcggtccgttaacggtttccggggaaccggggtacggggtaaacccgtaacggtccggtacggtaacccgtttacgtttaaacggtaccgaaccggacccgtaacggttcccgttcccggttcccccgttaacggtccctaaccgttccgttcccggttcccctccccgttcccttccccg

SEQ ID NO: 359156 - DNA, 623 bp, Homo sapiens
  misc_feature: GZ8MTXP01DZXH4.17.33.C11.1.454.CMB.2.raw
  modified_base (229)..(229): a, c, t, g, unknown or other
  misc_feature (229)..(229): n is a, c, g, or t
  modified_base (275)..(275): a, c, t, g, unknown or other
  misc_feature (275)..(275): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttccaacactggancagtcaccagtgtcttactactaccaaactggttccagcagaaacnggacaacgcaccagggcactctatttatagtaacaaacaacaaacactcctacgaccctcgccgtattctcgacggcctcccccgtcgttcgggggacaaacgctcgccctcgacacgtcgtctggtgtcgcgacgcgtggaggacggaggcgtagtactacttacgtcgtccttactcttacgtttgggggtgtgtctgtgtcgtacgtcggtacgggacggtaacgtagcgtacgtaaccgttacgttaaacgtccgttacggacccgaacggttccgttacccgttccccgtcgggtcctaaccgttcccgtcccgttcccctaacccctttcccgttaaccccg

SEQ ID NO: 359157 - DNA, 605 bp, Homo sapiens
  misc_feature: GZ8MTXP01BHAU8.17.33.C11.1.454.CMB.2.raw
  modified_base (271)..(271): a, c, t, g, unknown or other
  misc_feature (271)..(271): n is a, c, g, or t
  modified_base (299)..(299): a, c, t, g, unknown or other
  misc_feature (299)..(299): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgtcttactatccaaactggttccagcagaaaccnggacaacgcaccgagggcactcatttanagtaacaaacaaacaacactcctacggaccctcgccgattctcacggtcctcccccgtccggttgggggaccaaacggtcctacgcccgtcgaacctccgtgtcgtgggtgtggaccacgcgtaggacggacgtaggctacgtacttacgttactcgtaccttacttacgtttacggtttgggggtcggtcgtcgtcgtacgtcgtacggtccgggacggacggtacacgtcgtcgtaacgtcgttacgcgacgaccgacgccgccgcccgtcgtcctcgtccgtccgttccctcccgttccgtcg

SEQ ID NO: 359158 - DNA, 710 bp, Homo sapiens
  misc_feature: GZ8MTXP01BHQFB.17.33.C11.1.454.CMB.2.raw
  modified_base (271)..(271): a, c, t, g, unknown or other
  misc_feature (271)..(271): n is a, c, g, or t
  modified_base (295)..(295): a, c, t, g, unknown or other
  misc_feature (295)..(295): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccaggtccaattctcagactgtggtgactcaggagccctcactgactgtcgtccccgaggaggacagtcactctcacctgtgcttaccaacactggagcagtcaccagtcgcttactatccaaactgtccagcagaaaccngaacaagcaccaggcactcattanagtaacaaacaaacaaacactcctcgacccctgcccgtattctcacggccttacccccgtccggttggggaccaaacgcctaacgcccttgactacgtcgtcgtggtgtgcgacgcccgtggacgggacgtacggacttacggacttattacgtcgtcccttacttaccttaccgttttgggggtcggttcggtcttcggttacggtcgtttaacgggttccggggaccggggtaaacgggtaacccgtaaacggtcccgttacggtaacccggttacgtttaaacggttccgaacccggtaccccggaacgggccccgttccccggttacccccccgttccggggtacccgttaaccctttccccgttaccccggtttccccccgtaacccccgtttccccgtttaacccccgg

SEQ ID NO: 359159 - DNA, 624 bp, Homo sapiens
  misc_feature: GZ8MTXP01AWWNC.17.33.C11.1.454.CMB.2.raw
  modified_base (181)..(181): a, c, t, g, unknown or other
  misc_feature (181)..(181): n is a, c, g, or t
  modified_base (363)..(363): a, c, t, g, unknown or other
  misc_feature (363)..(363): n is a, c, g, or t
  modified_base (382)..(382): a, c, t, g, unknown or other
  misc_feature (382)..(382): n is a, c, g, or t
  modified_base (419)..(419): a, c, t, g, unknown or other
  misc_feature (419)..(419): n is a, c, g, or t
  modified_base (560)..(560): a, c, t, g, unknown or other
  misc_feature (560)..(560): n is a, c, g, or t
tcagcgtagactagcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccngcctacacgacttaaaccgggacaaccgtcgcccggccaacatacgccttcctcccgtccccccttgcagtaacaccaagtacagaatattaacctgttcccatcgactacgcctttcggcctcgccgttaggggtcactccaccctgccccgtattacgtgacaggaccctggtctccggngagcggtctttcgaccgtntttatcgttactatgtcagctaattccgctactttcncgtactacctccagcatcgcctcaacacgaccaacctaccttacaacgaacggtccttaaaccgaacgtaaacccgcccttaacccccaaacccaaacaaaccgcaactaacggccgtcgcgtcgccgcacgtctcggttntcttacgttcgtttaccgccccgtttcacttccctcccgctactcgttacgtaacgttcgtccg

SEQ ID NO: 359160 - DNA, 715 bp, Homo sapiens
  misc_feature: GZ8MTXP01BEKQF.17.33.C11.1.454.CMB.2.raw
  modified_base (189)..(189): a, c, t, g, unknown or other
  misc_feature (189)..(189): n is a, c, g, or t
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
  modified_base (339)..(339): a, c, t, g, unknown or other
  misc_feature (339)..(339): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaaccccacacagacccctnacgctgacctgccaccttcnctggcttcncactcaagaacgagtggaatggggagtgggctgggactcccggtacacgcccccgaggaacggccctggagtggcttgcgtctctagtttagtggatgagagtaagcactacacgtccgtntcgtagaagaacgacggctaccaccatacccaaccgaacgaaccaccctccaaacgaaacctagggtacgtaccttaacgaactacgaacctaaagtacgtacggacccttggacggaacaacgacgacccaataacttacttaacgttcgttaccggtaccgttcgttacgttacggtttacgggggttaccggggtacgttttaacgtttacccgtaccccgtttacgtttacggtaaccgttccgggtaacgggggtacccgttaagggtaaaccggttccggtcggtaacccgttccccggttccttcccggccgtacccggttcccctacccgacccggttaaccgggccccttaacggtttccccccggg

SEQ ID NO: 359161 - DNA, 585 bp, Homo sapiens
  misc_feature: GZ8MTXP01CHYLL.17.33.C11.1.454.CMB.2.raw
  modified_base (272)..(272): a, c, t, g, unknown or other
  misc_feature (272)..(272): n is a, c, g, or t
  modified_base (298)..(298): a, c, t, g, unknown or other
  misc_feature (298)..(298): n is a, c, g, or t
  modified_base (398)..(398): a, c, t, g, unknown or other
  misc_feature (398)..(398): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcagaaaccnggacaagcaccaggcactatatttanagtaacaaacaacaaacactacctcgaccccctgacccgattctcacggtcctcccccctccggttggggcaaagctacgccctgacacgtgtctggtgngcagcctaggaggacgaggctagactatactgtcctatcttacgtttggggtggtgtcgtgtgtcgttagtccgggacgggacggacaaggtctcggaaccgttacgttaacgtcgacgacccgtaaggcccgttccgccccgtggtcctaaccttccgtccgttcccctaacccgttccctaaccg

SEQ ID NO: 359162 - DNA, 677 bp, Homo sapiens
  misc_feature: GZ8MTXP01B7MOK.17.33.C11.1.454.CMB.2.raw
  modified_base (314)..(314): a, c, t, g, unknown or other
  misc_feature (314)..(314): n is a, c, g, or t
  modified_base (592)..(592): a, c, t, g, unknown or other
  misc_feature (592)..(592): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgcctaccttctctggcttctcactcagaacgagtggaagtggggagtgggcgtggactccgcacgccccgaggaacgccgtggagtgcttgcgctctagtttagtggatggaggtancacgtactacgtccgtctacgtagaacgaacgaggctaccacccactaccaacgaacgaccaaccctaccaacgaaaccgtggttacgtaccttacaatacgaacctaagtacgtacggacccgtggtacggaacacgacgaccactattacttactgtaccacggtcttagtagttacggggttcgggttatttacgttaccgttacccttagtttcgtaaaccgtccggtacgggggtaaccgtaacgggttaccgttcgttcgggtttaaccccnccggtttcccgcccgttaccgcccgtaccccgtaacccgaacccggaccggggttccccttaaccgttcccccgggtttcccccg

SEQ ID NO: 359163 - DNA, 699 bp, Homo sapiens
  misc_feature: GZ8MTXP01AX969.17.33.C11.1.454.CMB.2.raw
  modified_base (275)..(275): a, c, t, g, unknown or other
  misc_feature (275)..(275): n is a, c, g, or t
  modified_base (304)..(304): a, c, t, g, unknown or other
  misc_feature (304)..(304): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgcctgcccagggtccaattctcagactgtggtgactcaggagccctcactgactgtcgtccccaggagggacagtcactctcacctgtgcttccaacactggagcagtcaccagtgcttactataccaaactggttccagcaagaaaccnggaacaagccaccgagggcactcatttanagtaacaaacaaacaaacactacctacggaccccctgacccgtattccgtcacggtcctccccccgtccggttagggggaccaaacgccgtcgccctgacctacgtcgtcgttgggtcgtgcacggcctaggacggacggaggtctacggtacttacgttacctcgacccttacttactttaccggtttgggggtcggttcgtccgttggttcggccgtttagggttccgggacggggtaacgggtaccgtaaacgggtccgtacggtaacccgtttacgttaacggttacccgacggtaccccgaaagggttccccgttccgccccccggttgggtaccccttcccgttcccgttcccggttcccccggtccccctttaaccccgtttccccgg

SEQ ID NO: 359164 - DNA, 733 bp, Homo sapiens
  misc_feature: GZ8MTXP01DCBPL.17.33.C11.1.454.CMB.2.raw
  modified_base (223)..(223): a, c, t, g, unknown or other
  misc_feature (223)..(223): n is a, c, g, or t
  modified_base (328)..(328): a, c, t, g, unknown or other
  misc_feature (328)..(328): n is a, c, g, or t
  modified_base (490)..(490): a, c, t, g, unknown or other
  misc_feature (490)..(490): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtcccagggaggacagtcactctcacctgtcgcttaccaacnctggagcagtccaccgagtcgtacttactactacccaaacgttcggttaccaggacaacgaaaccgtggaacaacgccgaacccgagggaccactactaatttanaacgtaacaaaacaaaccaaacctacctccctacgggtaccccctcggaccccgtacttccgtacgacggtcccttcccccccgtccggtttacggggggacctaaacgcctaaccgcccctaaggacctacgttcggtcgtgggtcgtcgaccagtcccgnggacgggacgaggctaggacttattacgtcgtcctacgtacttacgtttgggggtggttcgtcgttgtacgtcgtttacggttcgggaccggggtacggaccgtaacggtccgtacggtaacccgttaacgttaaacggtccgaccggtacccgtaacgggttccgttccccggttacccccgttcggttaccctaaccgtttcccgtcccgtttcccccggtccccgttccctttaacccgg

SEQ ID NO: 359165 - DNA, 712 bp, Homo sapiens
  misc_feature: GZ8MTXP01C2929.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacacgacccctcacgctgacctgcctaccttctctggtcttctcactcaagaacgagtggaagtggggagtgggctggactcccgtacacggacccccgagggaaacggcccgtgggagtggcttgcgtcttactagtttagtgggatggaagaagtaacgctaactacgtacgtccgttactacgtagaaacgaacaggcctacccaaccataccgaaaccgaaacggaacccaaccctaaccgaaacctaaaccgtacgggttacgtacccttaaacgaaactacgaacctaaagtacgtacggtacccgtgtacggaacaacgacgaccaactaattacttacgtacgttacgacgtcttacgtaggttacggggttacgggtaagtttacgttaccgttccttaagtttacgaccgttaacgggtcggggaacccgttagggtaaccgttcgttccgggtaccttacccggttcacccggaacaccggtccctaccgaccggttaaccgggtccccttaacgtttccccgg

SEQ ID NO: 359166 - DNA, 652 bp, Homo sapiens
  misc_feature: GZ8MTXP01AL7FM.17.33.C11.1.454.CMB.2.raw
  modified_base (215)..(215): a, c, t, g, unknown or other
  misc_feature (215)..(215): n is a, c, g, or t
  modified_base (286)..(286): a, c, t, g, unknown or other
  misc_feature (286)..(286): n is a, c, g, or t
  modified_base (320)..(320): a, c, t, g, unknown or other
  misc_feature (320)..(320): n is a, c, g, or t
  modified_base (411)..(411): a, c, t, g, unknown or other
  misc_feature (411)..(411): n is a, c, g, or t
  modified_base (422)..(422): a, c, t, g, unknown or other
  misc_feature (422)..(422): n is a, c, g, or t
  modified_base (635)..(635): a, c, t, g, unknown or other
  misc_feature (635)..(635): n is a, c, g, or t
tcagcgtagactagcacgaccggtgctcgatttagagtgagctcgttggggtttggggggcgccaggggtcccttcaatatcagcaccatggcctggactcctctctttctgttcctcctcacttgctgcccagggtccaattctcagactgtggtgactcgaggacgccctcactgactgtcgtcccgaggaggacagtcactctcacctgtcncttaccaacacgtggagcagtccaccagtcgacttactagtacccaaacgtggttccagacaacgaaaccnggaacaacgccacccgaggcactctaagtttaanagtaaaccaaaacaaacaaacactccgtacgacccctcgccgtattctcgacggtccttcccccgtccggtacgggggacaaacgtcgtcncccgtgaaccncgttcgtcgtggttgcgcgacgtccgaggacggacggtaggactacgtactacttacgcgtccttaacgttactttacggttgggggtcggttgtccgtgtcgtacgttcggtcgggacggtacggaccgaacgtcgtacgtaacgtacgttacgccgaacgccgtacgccgttcccgttcccgtccgtctaaccttccgtacccttaccccncccgttccgttaacccg

SEQ ID NO: 359167 - DNA, 602 bp, Homo sapiens
  misc_feature: GZ8MTXP01AKG5S.17.33.C11.1.454.CMB.2.raw
  modified_base (308)..(308): a, c, t, g, unknown or other
  misc_feature (308)..(308): n is a, c, g, or t
  modified_base (408)..(408): a, c, t, g, unknown or other
  misc_feature (408)..(408): n is a, c, g, or t
tcagcgtagactagcacgaccggtgctcgatttagagtgagctcgttgggtttggggggcgccaggggtcccttccaatatcagcaccatgacctggactcctctctttctgttcctcctcacttgctgcccagggtccaattctcagactgtggtgactcaggagccctcactgactgtgtccccagggagggacagtcactctcacctgtgcttccaacactggagcagtcaccagtcgacttactataccaaacttcggtccagcaagaaaccgtggaacagccaccgagggcactacatttaanagtaacaaacaaacaaacactacctcgaccctgaccgtattccacacggcctccccgtcggtggggacaaagctacgccctgacactgtctggtgtgacngcctaggaggacgagactagacttagtactcgccttaactctttacgttggggtgtgtctgtgctaggttcggacgggtacggtaccacgcgtcggtaaccgtacttaacgcgacggaccctaacggggccttcccggttccccgtcggtacctcctttccgtcccgttaccctaacccgttcccgttaacccg

SEQ ID NO: 359168 - DNA, 596 bp, Homo sapiens
  misc_feature: GZ8MTXP01BMSXL.17.33.C11.1.454.CMB.2.raw
  modified_base (213)..(213): a, c, t, g, unknown or other
  misc_feature (213)..(213): n is a, c, g, or t
  modified_base (355)..(355): a, c, t, g, unknown or other
  misc_feature (355)..(355): n is a, c, g, or t
  modified_base (376)..(376): a, c, t, g, unknown or other
  misc_feature (376)..(376): n is a, c, g, or t
  modified_base (574)..(574): a, c, t, g, unknown or other
  misc_feature (574)..(574): n is a, c, g, or t
  modified_base (577)..(577): a, c, t, g, unknown or other
  misc_feature (577)..(577): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttcncactcagaacgagtggaagtgggagtggggctggactaccggtcgacgccccgaggaacggccctggagtggcttgcgctctatttagtgggatgagagtagcactacagtccgtactcgtagaagacaggctcccacctanacgaaccaacggaacctaccnccaaaccaaaccgaggttcggtaccttacgaatacgaacctaatacgtcggacccttaggacggaacacacgacccataacttacttacgtcgttacacggtcttacgttaggtcgggttcgggtatttaacgttcgttcctagtttgactacggtggggaccagggacttccgtagtccgacgttcttacgctaccnccncaccgacgtccgccgtccg

SEQ ID NO: 359169 - DNA, 760 bp, Homo sapiens
  misc_feature: GZ8MTXP01A10FI.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacacgaccctcacgctgacctgctaccttctctggcttctcactcgagaacgagtaggaagtggggagtgggctggactccgacgacgaccccgaggaacggcccgtggagtggcttgcgcttactagtttagttggatggaagtacgtaagcctaactacgtacgtccgtctcgtagaaacgaacgcggacctacccaaccactaccgaacccgaacggtaaccaacccctaacccaaaccgaaaccgtagggtaccgttacctaacaaacgtacgaaacctaagtacgtacggacccgttagacggaacaccgaacgtaccaactaattacttacgtcggttacctacgttacgttacgtacggtttacgggggttaccggggttaacgtttacgtttaaaccgttcccctttaacggtttacgtaacccgtttcgggggtaacggggtacccggttaaagggggtaaacccttccgggttcgggttaaccccttaccgggttccccttcccggaaccgtaccggtccccgttaaccccgacccggttaaccggggtaaccccttaacggtttcccccggg

SEQ ID NO: 359170 - DNA, 711 bp, Homo sapiens
  misc_feature: GZ8MTXP01E00PH.17.33.C11.1.454.CMB.2.raw
  modified_base (347)..(347): a, c, t, g, unknown or other
  misc_feature (347)..(347): n is a, c, g, or t
tcagcgtagactagcacgaccggtgctcgatttagagtgagctcgttggggtttggggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgctaccttctctggcttctcactcagaacgagtggaagtggggagtgggctggactccgtcacgcccccgaggaaaggccctggagtggcttgcgctctatttagtgggatgagagtaagcactacagtcccgtctcgtagaagaacncggcctacccaccactaccaaacccgaaacggaaccccaaccctcccaaaccgaaaacccgtacggggttacggttacctttaacaaactacgaaccctaaatacgtcggaaccctggtaggaaccacgacgacccaactattacttactcgttcgaacgtcttaccgttaggttcggggttacgggggtaatttacgttacgtttaccctttacgtttcgaaccgttcgggtcgggggtacccgttaacggggtaaccttccggttcggggttcccaaccccggttcgttccccggaacccggaccgtaacccccgtacccgaaccccgaaccgggggtcccccttaacggtttccccccggg

SEQ ID NO: 359171 - DNA, 646 bp, Homo sapiens
  misc_feature: GZ8MTXP01EQBJ7.17.33.C11.1.454.CMB.2.raw
  modified_base (397)..(397): a, c, t, g, unknown or other
  misc_feature (397)..(397): n is a, c, g, or t
  modified_base (599)..(599): a, c, t, g, unknown or other
  misc_feature (599)..(599): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctactctggtagaaacccacacagaccctcacgctgacctgcaccttctctggcttctcactcagaacgagtggaatgggagtgggctggactccgtcacgccccaggaaggccctggagtggctgcgctcagtttagtgggatggagagtaacgcactacgagtccgtctcgtagaaagaacgacggcctaccacctagacccaaccgaacggaaccaccctaaccaacctaaacccggnggttaccgtacttaacaatacgtaacctaagtacgtacggtacccgtaggacgaacacgacaccaatacttaacttacgtcgttaccgcgttcgttacgttaggttcggggttacggtagtttacgttaccgttacccttagttacgtaccgttacgggtccgggtacgttaacgggtaccttcggtccgtccacccgttcncccgcgccgtcccgtacccgaaccggaccgtcccgttaacggtcccg

SEQ ID NO: 359172 - DNA, 746 bp, Homo sapiens
  misc_feature: GZ8MTXP01B9VEC.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgctaccttctctggcttctcactcagaacgagtggaagtgggagtgggctggatcccgtcacgccccgaggaacggccctggagtggcttgcgctctagtttagtgggatggagagtaagcactacgtagtccgtctcgtagaaagaacgacggctacccaccactaccgaacccgaacggaacccaaccctccaaaccaaaccgtacgggtacggtacccttaacaaagttacgaacctaaagtactacgggaccctggtacggaaccacacgcctaactaacttaattaccgttcgtttaaccgacggttacctttacggttacggttacgggggtttacgggggttaacttttaaacgtttaccgttaccccgttaacgttttacgggaacctttaccggggtaacgggggtacccggttaaacgggggtaaccctttccggttccgggttacccgttaccccggtttccgaccccggtccgtaaccgtccccgttaaccccgacccgggttaaaccggggtcccccttaaggtttcccccccggg

SEQ ID NO: 359173 - DNA, 615 bp, Homo sapiens
  misc_feature: GZ8MTXP01BN924.17.33.C11.1.454.CMB.2.raw
  modified_base (224)..(224): a, c, t, g, unknown or other
  misc_feature (224)..(224): n is a, c, g, or t
  modified_base (241)..(241): a, c, t, g, unknown or other
  misc_feature (241)..(241): n is a, c, g, or t
  modified_base (269)..(269): a, c, t, g, unknown or other
  misc_feature (269)..(269): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (337)..(337): a, c, t, g, unknown or other
  misc_feature (337)..(337): n is a, c, g, or t
  modified_base (376)..(376): a, c, t, g, unknown or other
  misc_feature (376)..(376): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccgagggaggacagtcactctcacctgtgcttccaacnctggagcagtcacagtncttactataccaaatgtcagcaagaacnggacagcaccgaggcactntattanaagtaacaaacaacaaacactcctcggacccctgaccgattcncacggtcctccccctccggtggggaccaaagccgtaacnccctgacctacgtcgtcgtgggtgtcgctacggccgtaggacgggacgacggtctacgtacttacttactcgtccctacttacttacggttgggggtgtgtctggtcgtcttacggcggtacgggaggacctagccgtcgtaaccgttattacgtaccgacgacccgtaaggcccgttccgttcccccgttcggtcctaaccgttccgttcccggttcccctccccgttccttaacccg

SEQ ID NO: 359174 - DNA, 673 bp, Homo sapiens
  misc_feature: GZ8MTXP01CW7V7.17.33.C11.1.454.CMB.2.raw
  modified_base (286)..(286): a, c, t, g, unknown or other
  misc_feature (286)..(286): n is a, c, g, or t
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (641)..(641): a, c, t, g, unknown or other
  misc_feature (641)..(641): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtcgcttaccaacactggagcagtcaccagtcgtacttactactaccaaacgtggttaccagacaacgaaacccnggaacaagcaaccgaggcactntaatttanaagtaacaaaacaaacaaactactacctcgacccctcgccgtacttctacacggtcctccccccgttcggtgggggaccaaacgtctacgccctgactacgtcgtcgtaggtcgtcgacgtacgtccgtaggaacgggacgtaggacgtactaccgttaattaccgtacgtccttaacgttccgtttaacgggtttgggggttcggttcgtccgttggtaacgtcggttacggttcggggacgggaaacggtaccgaaagtcgtacggtaaccgttacttaaagggtcacgtaccgacgttccgttccgttccccgtaacgtccncgttccgtccgttcccctccttaaccgttccg

SEQ ID NO: 359175 - DNA, 637 bp, Homo sapiens
  misc_feature: GZ8MTXP01DXSRK.17.33.C11.1.454.CMB.2.raw
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (301)..(301): a, c, t, g, unknown or other
  misc_feature (301)..(301): n is a, c, g, or t
  modified_base (335)..(335): a, c, t, g, unknown or other
  misc_feature (335)..(335): n is a, c, g, or t
  modified_base (394)..(394): a, c, t, g, unknown or other
  misc_feature (394)..(394): n is a, c, g, or t
  modified_base (438)..(438): a, c, t, g, unknown or other
  misc_feature (438)..(438): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacacgtggagcagtcaccagtgcttactatccaaactggtaccagcanaaaccnggacaagcaacccgaggcactactatttanaagtaacaaacaacaaacactacctcggaccccngcccgattcctcgacggcctaccccctcggtgggacaagctcgccctgacacgtgtcgngtgtgacagcctaggacggacgaggtctagtaaccttatacgtnacctacttacgttacctttggggggtcgttcggtccttggtgtccgtaacgtttcggggaccgggtaacggtaacccgtaaaggcccgttaggtaaccccgttacgtttaaaggtacccaacgacccgtaaacgggccttaccggttccccctcgggtacctcccgttctcccggttccccgtccccttccctaacccg

SEQ ID NO: 359176 - DNA, 633 bp, Homo sapiens
  misc_feature: GZ8MTXP01B2E73.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtcttgtcctacgctggtgaaacccacacagaccctcacgctgacctgcaccttctctggcttctcactcagaacgagtggaatggggagtgggctggactccggtcacgcccccaggaacggccctggagtggcttgcgctcatttagttggatgagagtaagcaactacagtccgtctcgtagaagaacaggctaccgaccatccaacccgaaggaacccaccctaacccaacgaaacccgacgggttacgtaccttaacaaatcgaaccctaagtacgtcgggaccctaggtacggaacacacgaccactattacttactcgttacacgtcgttacctagttcgggttacggggtatttagttaccgttcccttacgtttacgtaccgttacggtcggggaccttaggggtacttcgtaccggtcacccggttccacccggcacgtcccctccaccggttaccggcccttaacggttccccg

SEQ ID NO: 359177 - DNA, 591 bp, Homo sapiens
  misc_feature: GZ8MTXP01DJXLP.17.33.C11.1.454.CMB.2.raw
  modified_base (228)..(228): a, c, t, g, unknown or other
  misc_feature (228)..(228): n is a, c, g, or t
  modified_base (274)..(274): a, c, t, g, unknown or other
  misc_feature (274)..(274): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (491)..(491): a, c, t, g, unknown or other
  misc_feature (491)..(491): n is a, c, g, or t
  modified_base (540)..(540): a, c, t, g, unknown or other
  misc_feature (540)..(540): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggaggacagtcactctcacctgtcgcttccaacactggancagtcaccagtgcttactactccaaactggttaccagcaagaaacnggacaacgcaccgaggcactacatttaataagtaacaaaacaacaaaacactccgtacggacccctggaccctattcctacgacggccttccccctccggttaggggacaaagtcgtaacgccctgactactgtcgtgcgtgcacgcctggaggcgagctagacttattcncncttacctgttactttggggtcgtgtctgcgtctgttcggacggngaaccgagtctgaaccgttacgttaaggtaccacgacgaacgggttccnccgttccccgtcgtccaacttccgtccgttcccctccccgttaacttcccg

SEQ ID NO: 359178 - DNA, 679 bp, Homo sapiens
  misc_feature: GZ8MTXP01AFVW7.17.33.C11.1.454.CMB.2.raw
  modified_base (290)..(290): a, c, t, g, unknown or other
  misc_feature (290)..(290): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagacccctcacgctgacctgcctaccttctctggtccttctcgactcgaaggaacgtagtaggaagtggggagtgggctggactccgtcacgccccgaaggaacgcctggngtggcttgcgtctactagtttagtggtatggaagtagtaacgctaactacgacgtccgtactacgtagaaacgaacgcggtacctaaccccacctactacccaaaccgaacggaaaccctaaccctaaccaaaccaaaccggtacggtacgttacctaacaatactaacccgtaatcggtacggaccgtagacggaactacacgacaactattaacgttactcgttacacgtactcgtagttacgggttacggttagttacgtttacgtccttacgttacgaaccgttcggtaacgggtacgacggtaccttcggtcgtaacccgttccgttccgttaccggccacgtccccgacccgaccggaaccgggtcccttaacgttcccccgg

SEQ ID NO: 359179 - DNA, 638 bp, Homo sapiens
  misc_feature: GZ8MTXP01CMGDM.17.33.C11.1.454.CMB.2.raw
  modified_base (298)..(298): a, c, t, g, unknown or other
  misc_feature (298)..(298): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcagaaacctggacaagcacccaggcactcatttanagtaacaaacaacaaacactcctcgacccctgccccgattcctcacggcctcccccctccggttgggggacaaagcctacgccctgactactgtctggtgtgcacgctggaggacgaggcgtagtacttattacgtcgtcctaactcttacgtttggggtggtcgtcctagtcgtacgttagttccgggacggtacggaccgtaacgtcgtacggtaacccgttacgttaacgtccgacggacccgtaacggttcccgttccggttcccccccgttcgggtacccttaacccgttcccgtttcccggttaccccctaaccccgttccccgtttaaccccg

SEQ ID NO: 359180 - DNA, 683 bp, Homo sapiens
  misc_feature: GZ8MTXP01DDGUQ.17.33.C11.1.454.CMB.2.raw
  modified_base (268)..(268): a, c, t, g, unknown or other
  misc_feature (268)..(268): n is a, c, g, or t
  modified_base (291)..(291): a, c, t, g, unknown or other
  misc_feature (291)..(291): n is a, c, g, or t
  modified_base (313)..(313): a, c, t, g, unknown or other
  misc_feature (313)..(313): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaaccngacagcacccaggcactcattanagtacaaacaacaaacactccnggaccccctgcccgtattcctcacggcctccccctccgtgggggcaaacgctcgccctgacaccgtgtaccgtgggtcgtcgccgacgccgtagggacgggacggaacggtccgttacggtaccgtttaattaacccgtcggtcccgttaacttaccgttacccgtttttggggggttcgggttcggtccgttgggttcgttacgttaacgttttccgggggaccggggaacgggtacccgaaaggtccgtacgggtaacccgttccgttaaagtcccgaagccccgtaacggttcccgttccggttcccccccgttggtacccctccttcccggttccgtttccccctaaccccgttcccgtttccccg

SEQ ID NO: 359181 - DNA, 665 bp, Homo sapiens
  misc_feature: GZ8MTXP01B6YWG.17.33.C11.1.454.CMB.2.raw
  modified_base (233)..(233): a, c, t, g, unknown or other
  misc_feature (233)..(233): n is a, c, g, or t
  modified_base (280)..(280): a, c, t, g, unknown or other
  misc_feature (280)..(280): n is a, c, g, or t
tcagcgtagactagcacgaccggtgctcgatttagagtgagctcgttgggtttgggggggcgccaggggtcccttccaatatcagcaccatggcctggactcctctctttctgttcctcctcacttgctgcccagggtccaattctcagactgtggtgactcaggagccctcactgactgtcgtccccgagggagggacagtcactctccacctgtgcttaccaacactggancagtcacagtgcttactataccaaacgtcggtaccagacaagaaccnggacaagccaccaggcactactatatagaacaaacaacaaacactccgtcgacccctcgaccgtattacctcgacgccgtcccccctccggttcggggacgaacgacgtccgtccctcgacctaccttcggtcgtagggtcggtgacgtcgtacgtggaacgggacggtacggacgttactacgttattacgtcctaccttacgttcgtttacgtttgggggttggtcggttattccggttgtacgttacggttcgggacgggacggtaccgacgtcgtacggtaacccgtattaacggcgttacgaacccgtaacggttcccttcccggttccccgtcccggtctaaccttcccgtccgttacccctcccttaacccgttcccg

SEQ ID NO: 359182 - DNA, 630 bp, Homo sapiens
  misc_feature: GZ8MTXP01AW8CA.17.33.C11.1.454.CMB.2.raw
  modified_base (292)..(292): a, c, t, g, unknown or other
  misc_feature (292)..(292): n is a, c, g, or t
  modified_base (318)..(318): a, c, t, g, unknown or other
  misc_feature (318)..(318): n is a, c, g, or t
  modified_base (321)..(321): a, c, t, g, unknown or other
  misc_feature (321)..(321): n is a, c, g, or t
  modified_base (338)..(338): a, c, t, g, unknown or other
  misc_feature (338)..(338): n is a, c, g, or t
  modified_base (469)..(469): a, c, t, g, unknown or other
  misc_feature (469)..(469): n is a, c, g, or t
  modified_base (505)..(505): a, c, t, g, unknown or other
  misc_feature (505)..(505): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcgaggagccctcactgactgtcgtccccgagggaggacagtcactctcacctgtcgcttaccaactacgtggacgcagtaccacctagttcgtacttactactacccaaacgtggttaccagcaagaaccgngaacagccaccgaggcatctatttanaanaacaaaacaacaaaccncgtcctaccggaccctacgcccgtattcctcgacgtccctcccccggtcgtaggggacaacgctcgacctgactactcgtcgtggtcgtagcagcgtaggacgggacgtaggcttagtacttaatacgtcncttacgttacgttggttggggttcgtagttctggtntcgtacggtcgggacgggtacgaccgtagtcgtacggtaactacttagccgacgtaccgagcccgttccgccccgttaacgaccttaaccgtccgtacccgttcccctaacccgttccttaaccg

SEQ ID NO: 359183 - DNA, 677 bp, Homo sapiens
  misc_feature: GZ8MTXP01E0NW7.17.33.C11.1.454.CMB.2.raw
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
tcagcgtagactagcacgaccggtgctcgatttagagtgagctcgttgggtttgggggggcgccaggggtcccttccaatatcagcaccatggcctggactcctctctttctgttcctcctcacttgctgcccagggtccaattctcagactggtggtgactcaggacgccctcactgactgtcgtccccagggagggacagtcactctcacctgtcncttccaacacgtggancagtcaccagtcgtcttaactactacccaaacgtcggttaccagacaaactaaacaggacaacgccaacccgacgggactactctaatttaaataagtaacaaaacaaacaaaccactacctcgacccctcgccgtacttctcacgcctcccccgtccgttcggggacaaagctcgcctcgacactgtcgtggtgtcgcacgccgtaggacgggacgagggctacgtacttacttacgtcgtaccttcttacgtttacgtttggggggttggttcggtcgttggtcgtcgttacggttacggggaccgggtaacggggaaccgaacgtcgtcggtaaccgttacgttaacggtaccgaacgacccgtaacggcccgttcccggaccccgtccgggtcctaacccgttcgttcccggttccccgtccccttcccgttaacccgg

SEQ ID NO: 359184 - DNA, 683 bp, Homo sapiens
  misc_feature: GZ8MTXP01AF5IA.17.33.C11.1.454.CMB.2.raw
  modified_base (301)..(301): a, c, t, g, unknown or other
  misc_feature (301)..(301): n is a, c, g, or t
  modified_base (456)..(456): a, c, t, g, unknown or other
  misc_feature (456)..(456): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccgaggagggacagtccactctcacctgtcgtccttaccaacacgtggacgctacgtaccaacctagtcgtacctttaactactacctaaacgtcggtaccagacaacgtaacgngaacacgaccaccgaggctactactaatttacgactaacaaacaaaccaacgacctccgtaccgaccctcggtacctacttcctcgacgtcccttcccccggtacggtcggggactaacgctaccgacctcgactacgtgtcgtgggtagcgacncgtcgaggaggacggagtcgtacgtactacttacgtccgttaccttacgttcgtttacgttcgggggttgtaccgtgttacggttagtccgtacggttccggggaacgggaccggtacgtacgtccgtacggtaacctacgttacgacgaccgaccgtacgttcccgttcccgacccgttcggtaccctccgttcccgttcccgttcccctccgttccgttaacccg

SEQ ID NO: 359185 - DNA, 539 bp, Homo sapiens
  misc_feature: GZ8MTXP02HAASI.17.33.C11.1.454.CMB.2.raw
  modified_base (321)..(321): a, c, t, g, unknown or other
  misc_feature (321)..(321): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggataccggtcacgccccaggaagccctggagtggcttgcgctcatttatgggatgagagtaagcactacagtccgtntctgaagacaggctccaccatcaccaagacacctccacaaacaggtgtcccttaanatcacaatancgacctgagacacagaccacatattactgtcactctctagtaggttcgggtagttagttacgtcttacttacgtacgtacgtacggtacgacggtacgtacgtcgtcgtaccgtccgtccgcgcgacctaccaccgaccggaccgacgtccg

SEQ ID NO: 359186 - DNA, 532 bp, Homo sapiens
  misc_feature: GZ8MTXP02H5FE6.17.33.C11.1.454.CMB.2.raw
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (281)..(284): a, c, t, g, unknown or other
  misc_feature (281)..(284): n is a, c, g, or t
  modified_base (288)..(288): a, c, t, g, unknown or other
  misc_feature (288)..(288): n is a, c, g, or t
  modified_base (291)..(292): a, c, t, g, unknown or other
  misc_feature (291)..(292): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (341)..(341): a, c, t, g, unknown or other
  misc_feature (341)..(341): n is a, c, g, or t
  modified_base (362)..(362): a, c, t, g, unknown or other
  misc_feature (362)..(362): n is a, c, g, or t
  modified_base (401)..(401): a, c, t, g, unknown or other
  misc_feature (401)..(401): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtcggggctgggactacggcgacgacccaggaagccngngngntnnnntatntgnngagagananacacagtctctnagaganagcnccacacacacacgacacncacaacacgtacgtactacanacacatagacgacgtacgacgacacacacacatatactntctactctctagtaggtaggtagtacgttacgttacttacttacgtacgtacgtacggtacgtacggtacgtacgtacgtacgtaccgtccgtccgccgacgaccgtaccaccgaccggaccgtacgtccg

SEQ ID NO: 359187 - DNA, 512 bp, Homo sapiens
  misc_feature: GZ8MTXP02F2OAI.17.33.C11.1.454.CMB.2.raw
  modified_base (296)..(296): a, c, t, g, unknown or other
  misc_feature (296)..(296): n is a, c, g, or t
  modified_base (410)..(410): a, c, t, g, unknown or other
  misc_feature (410)..(410): n is a, c, g, or t
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtacaaacaacaaacactcctggacccctgcccgattctcaggctcccctccttggggcaaagctcgcctgacactgtctggtgtgcagcctgagacgaggctgactattacngcctactctacttggtgtgctgtnctagttcggnggaggcaagctgaccgtctaagtcagcccaaggctcgcccctcggtcactctctcccaccctctaccc

SEQ ID NO: 359188 - DNA, 508 bp, Homo sapiens
  misc_feature: GZ8MTXP02JYAOF.17.33.C11.1.454.CMB.2.raw
  modified_base (368)..(368): a, c, t, g, unknown or other
  misc_feature (368)..(368): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatcgtcagccccaggaagcctggagtgctgcgctcatttatgggatgagagtaagcactacagtccgtctctgaagacaggctcaccatcaccaaggacacctccacaaaccaggtgtccttanaatgacccaaatatggaccctgtggacacagcccacatattactgttcacgctctatggttcgggagttatagtcctactttgactactgggccagggactctggcaccgtctccgcacgcctcaccacggcccatcccg

SEQ ID NO: 359189 - DNA, 547 bp, Homo sapiens
  misc_feature: GZ8MTXP02G13LO.17.33.C11.1.454.CMB.2.raw
  modified_base (423)..(423): a, c, t, g, unknown or other
  misc_feature (423)..(423): n is a, c, g, or t
  modified_base (434)..(434): a, c, t, g, unknown or other
  misc_feature (434)..(434): n is a, c, g, or t
  modified_base (509)..(509): a, c, t, g, unknown or other
  misc_feature (509)..(509): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtgggagtggctggatccgtcagccccaggaacggccctggagtggcttgcgctcatttattgggatgagagtaagcactacagtccgtctctgaaagaacaggctccaccatcaaccaaggaccacctccaacaaaccaggtcgtcctacaatgaaccaatatgaccctgtgacacagccaacatattactnttacacgtctntagtggtacgggtattattacgtccttacttgactacggtcgggacgtagggtactcgtacggtcctaccgtccnccgcgacgacctacccaccgaccggacccgaccgtccg

SEQ ID NO: 359190 - DNA, 564 bp, Homo sapiens
  misc_feature: GZ8MTXP02F08EL.17.33.C11.1.454.CMB.2.raw
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggataccggtcacgaccccaggaagcctggagtggctgcgctcatttatgggatgagagtaagcactacagtcctctctagaagaanaggctccaccaanacaacaacgaccaccnccaaacaaacgaggtacgtacctaacaatacaacaatagtacgacctgtacgacacacgactanatatactntacactctactagtaggtacggtagttagttacgttacttacttacgtacgtacgtacggtacgtacggtacgtacgtcgtcgtaccgtccgtccgccgacgaccgtacccgaccgaccggaccgtacgtccg

SEQ ID NO: 359191 - DNA, 499 bp, Homo sapiens
  misc_feature: GZ8MTXP02IVJT3.17.33.C11.1.454.CMB.2.raw
  modified_base (418)..(418): a, c, t, g, unknown or other
  misc_feature (418)..(418): n is a, c, g, or t
  modified_base (469)..(469): a, c, t, g, unknown or other
  misc_feature (469)..(469): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccgtcagccccaggaaaggcctggagtggcttgcgctcatttattgggatgagagtaaagcactacagtccgtctctgaaagacaggctcaccatcacaagacactcacaaaccagtgtcctacaatgaccaatatggacctgtgacacagcacatattactgttcacgntctatggttcggggattattagtccctatttgactactgggcagggactcnggtcacgtcncncncncncacacgcactcg

SEQ ID NO: 359192 - DNA, 535 bp, Homo sapiens
  misc_feature: GZ8MTXP02FYDV2.17.33.C11.1.454.CMB.2.raw
  modified_base (300)..(300): a, c, t, g, unknown or other
  misc_feature (300)..(300): n is a, c, g, or t
  modified_base (423)..(423): a, c, t, g, unknown or other
  misc_feature (423)..(423): n is a, c, g, or t
  modified_base (480)..(480): a, c, t, g, unknown or other
  misc_feature (480)..(480): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcgacctgtgcttccaacactggagcagtcaccagtgcttactatccaaactggttccagcagaaacctggacaagcacccgagggcacgtcatttanagtacaaacaacaaacactcctaggacccctgcccgattctcacggctcccccctccgttggggacaagctcgcctgacactgtctggtgtgcagccgtgaggacgtaggctagactattacngcctactctacttggtgtgctgtgctagttcggcggtaggacaagtctagtaccgtnttaaagtcagccctaaggcctcgcccctggtccacgtctcgttcccacctcctcc

SEQ ID NO: 359193 - DNA, 520 bp, Homo sapiens
  misc_feature: GZ8MTXP02IKH4Y.17.33.C11.1.454.CMB.2.raw
tcagcgtagactagcacgaccggtgctcgatttagagtgagctcgttgggtttggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctggacaagcacccagggcactcatttatagtacaaacaacaaaacactcctggacccctgcccgattctcaggctcccctcctggggcaaagctgccctgacactgtctggtgtgcagcctgagacgaggctgactattactgcctactctactttggtgtgctgtgctagtcggcggagggtaccaagcgtgaccgtcttaaagctacgcccaaggctcgccccctggtccactctcgtcccaccctccttcc

SEQ ID NO: 359194 - DNA, 513 bp, Homo sapiens
  misc_feature: GZ8MTXP02I0I1O.17.33.C11.1.454.CMB.2.raw
  modified_base (467)..(467): a, c, t, g, unknown or other
  misc_feature (467)..(467): n is a, c, g, or t
tcagcgtagactagcacgaccggtgctcgatttagagtgagctcgttgggtttggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctggacaagcacccagggcactcatttatagtacaaacaacaaaacactcctggacccctgcccgatctcaggctcccctcctggggcaaagctgccctgacactgtctggtgtgcagcctgaggacgaggctgactattactgcctactctactttggtggttgctgtgctagttcggcggagggaccaagctgaccgtnttaagtcagccaaggctcgcccctggtcactctcgtcccgcctctc

SEQ ID NO: 359195 - DNA, 510 bp, Homo sapiens
  misc_feature: GZ8MTXP02FXPDQ.17.33.C11.1.454.CMB.2.raw
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaaggccctggagtggcttgcgctcatttatgggatgagagtaagcactacagtccgtctctgaagaacaggctcaccatcacaagacactcacaaacngtgtcctanatgacaatatgacctgtgacacagccacatattactgttacacgtctctatggttcgggagttatagtccctattgactacgtgggccagggaactcgtacggtcacgtctccgcacgcctccacaacgggcccagtcccgg

SEQ ID NO: 359196 - DNA, 523 bp, Homo sapiens
  misc_feature: GZ8MTXP02HJ4A3.17.33.C11.1.454.CMB.2.raw
  modified_base (405)..(405): a, c, t, g, unknown or other
  misc_feature (405)..(405): n is a, c, g, or t
  modified_base (462)..(462): a, c, t, g, unknown or other
  misc_feature (462)..(462): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacagcaccaggcactcatttatagtacaaacaacaaacactcctggacctctgcccgattctcagcctccctctggggcaagctgccctgacactgtctggtgtgcagcctgaggacgaggctgactagtacngcctactcttactttggtgtgctgtgctagttcggcggagggaccaagctgaccgtnttaaacgtcacgcccaaggcctacgcccccgtcggtccactcctcgttccccgcccttccc

SEQ ID NO: 359197 - DNA, 599 bp, Homo sapiens
  misc_feature: GZ8MTXP02HFGTU.17.33.C11.1.454.CMB.2.raw
  modified_base (324)..(324): a, c, t, g, unknown or other
  misc_feature (324)..(324): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtcggggctgggatacggtcacgaccccaggaagccctggagtggctgcgctcatttatgggatgagagtaagcactacagtccgtntctgaaagacaggctccacatcaccaagaccacctccaaccaaacaggtcgtacctacatacaccaatatcggaccctgtacgacacacgaccctaatatacttacgtcgttacacgtctacgtaggttcgggttacgggtagtttacgttaccgttcctttacgtttacgtacgtacggtacgggtacggtacgggtacgttacgtacggtaccgtaccgtaccgtccgtccgaccgtacccgtacccgaccgaccggtacccgtaccgtcccg

SEQ ID NO: 359198 - DNA, 533 bp, Homo sapiens
  misc_feature: GZ8MTXP02HJR7R.17.33.C11.1.454.CMB.2.raw
  modified_base (296)..(296): a, c, t, g, unknown or other
  misc_feature (296)..(296): n is a, c, g, or t
  modified_base (463)..(463): a, c, t, g, unknown or other
  misc_feature (463)..(463): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtacaaacaacaaaacactcctggacccctgcccgattctcacggctccccctccttggggcaaagctgccctgacactgtctggtgtgcagcctgaggacgaggctgactatactgcctactctactttggtggtgctgtgctagttcggcggagggaccaagcngaccgtcttaagtcagcccgaaggctcgccccctaaggtcctactttcgtccccgtccctcctccctacg

SEQ ID NO: 359199 - DNA, 525 bp, Homo sapiens
  misc_feature: GZ8MTXP02JL3D1.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaaacactcctgacccctgcccgatctcaggctcccctccttggggcaaagctgccctgacactgtctggtgtgcagcctgaggacgaggctgactattactgcctactctactttggtcgtgctgtgctagttcggcggaggaccaagctgaccgtcttaagtcacgcccaaggcctcgccccctcggtcactctcgttccccgccctcctcccg

SEQ ID NO: 359200 - DNA, 531 bp, Homo sapiens
  misc_feature: GZ8MTXP02IM38H.17.33.C11.1.454.CMB.2.raw
  modified_base (297)..(297): a, c, t, g, unknown or other
  misc_feature (297)..(297): n is a, c, g, or t
  modified_base (427)..(427): a, c, t, g, unknown or other
  misc_feature (427)..(427): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtacaaacaacaaaacactcctggacccctgcccgatctcagctcccctccttggggcaaagctgccctgacactgtctggtgtgcagcctgagacgaggctgactattactgcctactctactttggnggtgctgtgctattcggcggagggaccaagctgaccgtcgttaagtcagacccaaggccttcgcccccgtggtccacgttcctcgttccccgtccctcctcccg

SEQ ID NO: 359201 - DNA, 555 bp, Homo sapiens
  misc_feature: GZ8MTXP02HMKXC.17.33.C11.1.454.CMB.2.raw
  modified_base (486)..(486): a, c, t, g, unknown or other
  misc_feature (486)..(486): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaaacctggacaagcaccaggcactcatttatagtacaaacaacaaaacactcctcggacccctgcccgattcctcacggcctccccctccgttggggcaaacggctcgccctgacctactgtctgggtgtgcagcctggacggacgaggctagactattactgcctactcttactttggtgttgctgtgtctagttcggcggacggaccaagctcgaccgttnttaagtcagaccctaggcctccgcccctcggtccacgttccgtccgttcccccgcccttacccttcccg

SEQ ID NO: 359202 - DNA, 558 bp, Homo sapiens
  misc_feature: GZ8MTXP02H8SR0.17.33.C11.1.454.CMB.2.raw
  modified_base (299)..(299): a, c, t, g, unknown or other
  misc_feature (299)..(299): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggttccagcagaaacctggacaagcacccaggcactcatttanagtaacaaaacaacaaaacactcctcggacccctgccccgattctcacgcctccctcctggggcaaagctcgccctgaccactgtctggtgtgcagcctgaggacgaggctgactattactgcctactctacgtttggtggtgcttgtgtctagttcggcggagggaccaagtcgtcggtacccgttacgttaaacgtcgtacgtccaacggcctccggccccctcggtcctaccgtccttccgtttccccctaccccc

SEQ ID NO: 359203 - DNA, 517 bp, Homo sapiens
  misc_feature: GZ8MTXP02HSKAE.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaggccctggagtggcttgcgctcatttattgggatgagagtaagcactacagtccgtctctgaagacaggctcacatcacagacactccacaacagtgtaactcaatgaccaatatggaccctgtgacacagcacatatactgttcacgtctctagtggttcgggagttagttacgtcctatttgactacgtcggggccagggactcgtcggtcaccgtctccgcacgccctccaccgaacggcccagtcccgg

SEQ ID NO: 359204 - DNA, 518 bp, Homo sapiens
  misc_feature: GZ8MTXP02GKNND.17.33.C11.1.454.CMB.2.raw
tcagcgtagactagcacgaccggtgctcgatttagagtgagctcgttgggtttggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgatctcaggctcccctccttggggcaaagctgccctgacactgtctggtgtgctagcctgagacgaggctgactattactgcctactctactttggtcggtgctgtgcttagttcggcggtagggccaagtctgtaccgtcttaaagtcagcccaagctcgcccctggtcactctcgtcccgcctctcc

SEQ ID NO: 359205 - DNA, 522 bp, Homo sapiens
  misc_feature: GZ8MTXP02JOVO8.17.33.C11.1.454.CMB.2.raw
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaaagacaggctccaccatcaccaaggacacctccacaaaccaggtgtaccttacaatgaccaatatggaccctgtgacacagccacatattactgttcacgctctatggttcggggagttattagtccctatttgactacgtcggggccaggggaactctggtccacgtctcgcagcctcaccacggcccagtccgg

SEQ ID NO: 359206 - DNA, 518 bp, Homo sapiens
  misc_feature: GZ8MTXP02I7D96.17.33.C11.1.454.CMB.2.raw
  modified_base (297)..(297): a, c, t, g, unknown or other
  misc_feature (297)..(297): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgtcttccaacactggagcagtcaccagtgcttactatccaaactggttccagcagaaacctggacaagcacccaggcactcatttanagtacaaacaacaaacactcctggacccctgcccgatctcaggctcccctccttggggcaaagctcgccctgacactgtctggtgtgcagcctgagacgaggctgactattactgcctactctactttggtggtgctgtgctagttcggcggaggaccaagctgaccgtcttaaagtcagcccaaggctcgcccctggtcactctcgtcccgcctccttcc

SEQ ID NO: 359207 - DNA, 664 bp, Homo sapiens
  misc_feature: GZ8MTXP02G7LMM.17.33.C11.1.454.CMB.2.raw
  modified_base (346)..(346): a, c, t, g, unknown or other
  misc_feature (346)..(346): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtggggctgggactacggtcgacgaccccaggaagcctggagtggcttgcgctcatttattgggatgagagtaagcactacagtccgtctctgaagaacaggctccacancaccaaggaccacctccaacaaacccaggtacggtaccttacaattcgaaaccaattaatcgggaaccccttgtcgggaaccacccgaaacgaccctaactacttaacttaaccgttcgttaccgtaccgtaccgttacgttacggttacggggttacggggttaacggtttaacgtttaccgtttacccgttaccgtttacgttacgttaccggtacggggtaccggtacgggtacgtaccggttacggtaccgtaccgtaccgtaccgtccgtaccgtacccgtacccgacccgaaccggacccgtaccgtcccgg

SEQ ID NO: 359208 - DNA, 600 bp, Homo sapiens
  misc_feature: GZ8MTXP02HE6YN.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggactccggtcacgccccaggaacgcctggagtggcttgcgctctattagtgggatggagagtaagcactacacgtccgtctctagaagaacaggctaccaccatacaaccaaggtacccacctccaaacaaaccgagggttaccgtaccttaacaatacgaaccaaatacgtacggacccttaggacgaacaccacgacccaactatacttactgttacacgtctctagtgggttacgggtattacgttacgtcccttagtttacgaccttacggtcggggacctaggggtaaccttcggtacggtccgaccgtctaccgcacgccctacaacccgacggccctacgttccccgg

SEQ ID NO: 359209 - DNA, 540 bp, Homo sapiens
  misc_feature: GZ8MTXP02HO5NT.17.33.C11.1.454.CMB.2.raw
  modified_base (353)..(353): a, c, t, g, unknown or other
  misc_feature (353)..(353): n is a, c, g, or t
  modified_base (400)..(400): a, c, t, g, unknown or other
  misc_feature (400)..(400): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatggggagtgggctggatccgtcacgcccccaggaaaggccctggagtggcttgcgctcatttatgggatgagagtaagcactacagtccgtctctgaagacagctccacatcacagacacnccacaaacagtcgtctacatgacaatatcgacctgtgacacagccanatattactgttcacgtctctagtgggttcgggagtttattacgtcccttaagtttcgactaccggttggggaccagggtaacctcgtacggtccaccgttcctccgcacgccctcgacccgaacgggccctacgttcccg

SEQ ID NO: 359210 - DNA, 555 bp, Homo sapiens
  misc_feature: GZ8MTXP02H8MFG.17.33.C11.1.454.CMB.2.raw
  modified_base (519)..(519): a, c, t, g, unknown or other
  misc_feature (519)..(519): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaggccctggagtggcttgcgctcatttatgggatgagagtaagcactacagtccgtctctagaaagaacaggctccaccatcaaccaaaggaccacctccaacaaaaccagggtacgtaccttaacaaatacgaacccaaatatcggaccctgtagacacagccaacatattactgttcacgtctctatgggttcgggattattacgtccttattgactacgtcggggccagggaactcgtcggtaccaccgttccnccgcgacgccctaccaaccgaccggccctacgtccg

SEQ ID NO: 359211 - DNA, 543 bp, Homo sapiens
  misc_feature: GZ8MTXP02HCB4Y.17.33.C11.1.454.CMB.2.raw
  modified_base (415)..(415): a, c, t, g, unknown or other
  misc_feature (415)..(415): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcattattgggatgagagtaagcactacagtcccgtctctgaaagaacaggctccaccatcaccaaggaccacctccaacaaaccaggtgtaccttacaatgaccaatactgaccctgtgacacagccanatattactgttcacgtctctagtggttacggggattattacgtccttactttgacttacgtggggacccagggaactcgtcggtccaccgtctccgcacgccctccaccgaacggcccacgttcccgg

SEQ ID NO: 359212 - DNA, 528 bp, Homo sapiens
  misc_feature: GZ8MTXP02FXHB1.17.33.C11.1.454.CMB.2.raw
  modified_base (415)..(415): a, c, t, g, unknown or other
  misc_feature (415)..(415): n is a, c, g, or t
  modified_base (499)..(499): a, c, t, g, unknown or other
  misc_feature (499)..(499): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaaggccctggagtggctgcgctcatttattgggatggagagtaagcactacagtccgtctctgaagaacaggctccaccatcaccaagaccacctccaacaaaccaggtcgtccttaacaatgaaccaatatcggaccctgtgacacagccanatattactgttcacgctctagtggttcgggattatagtcctatttgactacgtgggccagggactcgtcggtcaccgtctccgngacgcctaccaccgacggcccagtcccgg

SEQ ID NO: 359213 - DNA, 626 bp, Homo sapiens
  misc_feature: GZ8MTXP02JWNNZ.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactaccggcacgaccccaggaacgcctggagtggcttgcgctcatttagtgggatgagagtaagcactacagtccgtctcgtagaaacgaacacggctaccaccatacaaccaacggaccacctaccaaaccaaaccgaggtcgtaccttaacaagtcgaaccaaattagacgtaacccgtggtacgacacacgacccatattaattaccgttcgtaccacgtcttacgttaggttacgggttacggttacgttacgttaccgttaccgttacgttacgtacgttacgggtacgggtaccgtaggtacgtcggtacggtaccctaccggttccgacccgtaacgaccgtaccctaccgaccgaccggtaccgtaccgtccg

SEQ ID NO: 359214 - DNA, 549 bp, Homo sapiens
  misc_feature: GZ8MTXP02G2O67.17.33.C11.1.454.CMB.2.raw
  modified_base (278)..(278): a, c, t, g, unknown or other
  misc_feature (278)..(278): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (308)..(308): a, c, t, g, unknown or other
  misc_feature (308)..(308): n is a, c, g, or t
  modified_base (354)..(354): a, c, t, g, unknown or other
  misc_feature (354)..(354): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
  modified_base (415)..(415): a, c, t, g, unknown or other
  misc_feature (415)..(415): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtggggctgggactacggcagacccctaggaagccctgaggngntgcnctntattagtggagtgagagaganactacacgtcgtctctagaagacgagcaccacacacacacgacacnccaacaacagtacgtactacananacaatatacgacgtagacgacacacacacatatactntacactctactagtggtacggtagttagttacgtacttacttacgtacgtacgtacggacggacggtacgtacgtacgtaccgtaccgtccgtaccgaacgaccgaccgaccgaccgaccggaccgtacgtccg

SEQ ID NO: 359215 - DNA, 526 bp, Homo sapiens
  misc_feature: GZ8MTXP02GDD8N.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccctctctggcttctcactcagaacgagtggaatgggagtgggctggatccgtcagcccccaggaaaggccctggagtggcttgcgctcatttatgggatgagagtaagcactacagtccgtctctgaagaacaggctccaccatcaccaagacacctccacaaaccaggtgtccttacaatgaccaatatggaccctgtgacacagccacatattactgttcacgctctatggttcggggagttattagtccctatttgactacgtggggccagggaactcgtggtcaccgtctccgcacgccctccaccaacgggcccagtcccgg

SEQ ID NO: 359216 - DNA, 534 bp, Homo sapiens
  misc_feature: GZ8MTXP02G1IQP.17.33.C11.1.454.CMB.2.raw
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaagccctggagtggcttgcgctcatttatgggatgagagtaagcactacagtccgtctctgaagacaggctccaccatcacagacacctcacaaacngtgtcctanatgacaatactgaccctgtagacacagaccacatattactgttcacgtctcttagtgggttacgggtagttattacgtcccttatttgacttacgtcgggaccagggtaactcgtcggtccaccgtctccgcgacgccctaccaccgaacgggcccacgttcccgg

SEQ ID NO: 359217 - DNA, 557 bp, Homo sapiens
  misc_feature: GZ8MTXP02ICU5Z.17.33.C11.1.454.CMB.2.raw
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaaggccctggagtggcttgcgctcatttattgggatgagagtaagcactacagtccgtctctgaagacaggctccaccatcaccaaggaccacctccaacaaaccaggtcgtaccttacaatgaaccaataccggaccctgtggacacacgccacatattactgttcacgctctattgggttacgggagtttattacgttcccttactttggactacgtcggggaccaggggaactcgtggtcctaccggtctccgcaacgccctaccaccgaacggcccctaagtccggttcccc

SEQ ID NO: 359218 - DNA, 523 bp, Homo sapiens
  misc_feature: GZ8MTXP02IVL7S.17.33.C11.1.454.CMB.2.raw
  modified_base (501)..(501): a, c, t, g, unknown or other
  misc_feature (501)..(501): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaagccctggagtggcttgcgctcatttatgggatgagagtaagcactacagtccgtctctgaagaacaggctccacatcaccaagacacctcacaaacagtgtcctacaatgacaatatgaccctgtgacacagccaacatattaactgtttcacgtctactagtgggttcgggtagttattaggtaccctatttgactacgttcggggccaggggaactcgtggtcaccgtctccgcncgctccaccacggaccactccg

SEQ ID NO: 359219 - DNA, 514 bp, Homo sapiens
  misc_feature: GZ8MTXP02JQGAZ.17.33.C11.1.454.CMB.2.raw
  modified_base (466)..(466): a, c, t, g, unknown or other
  misc_feature (466)..(466): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgatctcaggctcccctccttggggcaaagctgccctgacactgtctggtgtgcagcctgaggacgaggctgactattactgcctactctactttggtgtgctgtgctagttcggcggagggaccaagctgaccgtntaagtcagcccaaggctcgccccctggccactctgtcccaccctctcc

SEQ ID NO: 359220 - DNA, 533 bp, Homo sapiens
  misc_feature: GZ8MTXP02J099F.17.33.C11.1.454.CMB.2.raw
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttatgggatgagagtaagcactacagtccgtctctgaagacaggctcaccatcaccaggacacctccacaaaccagtgtccttacaatgaccaatatggaccctgtggacacagccacatattactgttcacgctctagtggttcgggagttattagtccctactttgactacgtcggggcaggggaactcgtcggtccaccggtctccgctacgccctaccaccgaacgggcccacgttcccgg

SEQ ID NO: 359221 - DNA, 517 bp, Homo sapiens
  misc_feature: GZ8MTXP02GK1GE.17.33.C11.1.454.CMB.2.raw
  modified_base (295)..(295): a, c, t, g, unknown or other
  misc_feature (295)..(295): n is a, c, g, or t
tcagcgtagactagcacgaccggtgctcgatttagagtgagctcgttgggtttggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtacaaacaacaaaacactcctggacccctgcccgattctcaggctcccctcctggggcaaagctgccctgacactgtctggtgtgcagcctgaggacgaggctgactattactgcctactctactttggtgtgctgtgctagttcggcggagggaccaagctgaccgtcttaagtcagcccaaggcctgccccctcggtcactctcgtcccgcctctccc

SEQ ID NO: 359222 - DNA, 532 bp, Homo sapiens
  misc_feature: GZ8MTXP02IBI7D.17.33.C11.1.454.CMB.2.raw
  modified_base (472)..(472): a, c, t, g, unknown or other
  misc_feature (472)..(472): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaaacaaaacactcctggacccctgcccgatctcaggctccccctccttggggcaaagctgccctgacactgtctggtgtgcacgcctgaggacgaggctgactattactgcctatcttactttggtgttgctgtgtctagttcggcggagggaccaagctgaccgtnttaagtcacgccgaaggcctcgccccctcggtccacgtctcgttccccaccttcctcccg

SEQ ID NO: 359223 - DNA, 514 bp, Homo sapiens
  misc_feature: GZ8MTXP02JL9I6.17.33.C11.1.454.CMB.2.raw
tcagcgtagactagcacgaccggtgctcgatttagagtgagctcgttgggtttgggggcgccaggggtcccttccaatatcagtaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcacggctccctcccgttggggcaaagctgccctgcactgtctggtgtgcagcctgaggacgagctgactatactgcctactctactttggtgtgctgtgctagttcggcggagggacaagctcgacgtctaagcacgccaaggctcgcccctgcactctcgtcccaccctcctctacg

SEQ ID NO: 359224 - DNA, 539 bp, Homo sapiens
  misc_feature: GZ8MTXP02J1HHP.17.33.C11.1.454.CMB.2.raw
  modified_base (515)..(515): a, c, t, g, unknown or other
  misc_feature (515)..(515): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtaacaaacaacaaacactcctcggacccctgcccgattctcaggctccccctcttggggcaaagctgccctgacactgtctgtgtgcagcctgaggacgaggctgactattactgcctacttctactttggtggtgtctgtgtctagttcggcggagggacccaagtcgtacgtaccgtcttaaagcgaacgccctaacgcctcgccccctcggtccncgtctccgtcccgccctccctccg

SEQ ID NO: 359225 - DNA, 515 bp, Homo sapiens
  misc_feature: GZ8MTXP02H5TPJ.17.33.C11.1.454.CMB.2.raw
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (279)..(284): a, c, t, g, unknown or other
  misc_feature (279)..(284): n is a, c, g, or t
  modified_base (286)..(286): a, c, t, g, unknown or other
  misc_feature (286)..(286): n is a, c, g, or t
  modified_base (289)..(291): a, c, t, g, unknown or other
  misc_feature (289)..(291): n is a, c, g, or t
  modified_base (293)..(293): a, c, t, g, unknown or other
  misc_feature (293)..(293): n is a, c, g, or t
  modified_base (295)..(296): a, c, t, g, unknown or other
  misc_feature (295)..(296): n is a, c, g, or t
  modified_base (298)..(298): a, c, t, g, unknown or other
  misc_feature (298)..(298): n is a, c, g, or t
  modified_base (300)..(301): a, c, t, g, unknown or other
  misc_feature (300)..(301): n is a, c, g, or t
  modified_base (303)..(305): a, c, t, g, unknown or other
  misc_feature (303)..(305): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (313)..(313): a, c, t, g, unknown or other
  misc_feature (313)..(313): n is a, c, g, or t
  modified_base (330)..(330): a, c, t, g, unknown or other
  misc_feature (330)..(330): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtcggggctgggctacggcagacccctaggaagcccngngngnnnnnntntgnnnanannananncnnnananagcncacacacacacgacacncacaacacgtgtactacanacacanatacgacgtagagacacacacacatatactactacactctactacgtaggtacggtagttacgttacgtacttacttacgtacgtacgtacggacgacggacgtacgtacgtacgtaccgtcgtccgcgacgacctaccgaccgaccgaccgtacgtccg

SEQ ID NO: 359226 - DNA, 520 bp, Homo sapiens
  misc_feature: GZ8MTXP02JBFN2.17.33.C11.1.454.CMB.2.raw
  modified_base (320)..(320): a, c, t, g, unknown or other
  misc_feature (320)..(320): n is a, c, g, or t
  modified_base (493)..(493): a, c, t, g, unknown or other
  misc_feature (493)..(493): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaggccctggagtggcttgcgctcatttattgggatgagagtaagcactacagtccgtntctgaagaacaggctccacatcaccaagaccacctccacaaacaggtgtccttacatgaccaatatggaccctgtgacacagccacatattactgttcacgtctctatgggttcgggattatagtcccttatttgactacgtggggccagggactcgtggtcaccgtctccgnacgcctcaccacgggcccagttcccgg

SEQ ID NO: 359227 - DNA, 532 bp, Homo sapiens
  misc_feature: GZ8MTXP02J0OMQ.17.33.C11.1.454.CMB.2.raw
  modified_base (444)..(444): a, c, t, g, unknown or other
  misc_feature (444)..(444): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaacaaaacactcctcggacccctgcccgattcctcaggctcccccctccgttggggcaaacgctcgccctgacactgtctggtgtgcagcctgaggacgaggctagactattactgcctactcttactttggtggtgntgtgctagttcggcggagggaccaagcgtgaccgtctagtcacgccaacgcctcgcccctcgtccactctccgtcccgccctctcccg

SEQ ID NO: 359228 - DNA, 552 bp, Homo sapiens
  misc_feature: GZ8MTXP02IRC1I.17.33.C11.1.454.CMB.2.raw
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaaggccctggagtggctgcgctcatttatgggatgagagtaagcactacagtccgtctctgaaagacaggctcaccatcaccaaggacacctcacaaaccagtgtccttacaatgaccaatatggaccctgngacacanccaanatattactntcacnctctagtggttacggtagttagttacgtaccttacttacgtacgtacgtacggtacggacggtacgtacgtacgtaccgtaccgtccgtccgccgacgaccgtacccgaccgaaccggacccgtaccgtccg

SEQ ID NO: 359229 - DNA, 541 bp, Homo sapiens
  misc_feature: GZ8MTXP02JVM7I.17.33.C11.1.454.CMB.2.raw
  modified_base (419)..(419): a, c, t, g, unknown or other
  misc_feature (419)..(419): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttatgggatgagagtaagcactacagtccgtctctgaaagaacaggctccaccatcaccaaggacacctccaacaaaccaggtgtccttacaaatcgaccaatactcggaccctgtcgacacacgaccanatattactgttacacgtctctagtggttacggggatttagttacgtccctatttgactacgtcggggaccagggaactcgtggtccaccgtctccgcacgccctcacctacggcccatcccg

SEQ ID NO: 359230 - DNA, 546 bp, Homo sapiens
  misc_feature: GZ8MTXP02GQ591.17.33.C11.1.454.CMB.2.raw
tcagcgtagactagcacgaccggtgctcgatttagagtgagctcgttgggtttgggggcgccaggggtcccttccaatatcagtaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaaacctggacaagcacccaggcactcatttatagtaacaaacaacaaacactcctggacccctgcccgattctcaggctcctcccttggggcaaagctgccctgcactgtctgtgtgcagcctgaggacgaggctgactattactgcctactctactttggtcggtgtcgtgtgtctagttcgggcggtacgggaccaagcgtagacccgttcttaaacggtcaacgcccaaggcctcgcccccgtcggtcactcgtcgttccccacccttccctacttaccg

SEQ ID NO: 359231 - DNA, 527 bp, Homo sapiens
  misc_feature: GZ8MTXP02GMXCU.17.33.C11.1.454.CMB.2.raw
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
  modified_base (404)..(404): a, c, t, g, unknown or other
  misc_feature (404)..(404): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttatgggatgagagtaagcactacagtccgtctctgaagaacaggctccacatcacaagacactccaacaaacaggtgtcctanatgaccaatancgacctgtagacacagccanatatactgttacacgtctctagtggttacgggattattacgtccttattgactacgtggggccagggactcgtaggtccaccgtctccgcgacgccctaccaccgaacgggcccagttccccg

SEQ ID NO: 359232 - DNA, 576 bp, Homo sapiens
  misc_feature: GZ8MTXP02HJM8Y.17.33.C11.1.454.CMB.2.raw
  modified_base (319)..(319): a, c, t, g, unknown or other
  misc_feature (319)..(319): n is a, c, g, or t
  modified_base (343)..(343): a, c, t, g, unknown or other
  misc_feature (343)..(343): n is a, c, g, or t
  modified_base (547)..(547): a, c, t, g, unknown or other
  misc_feature (547)..(547): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatcgtcacgccccaggaagccctggagtggctgcgctcatttattgggatgagagtaagcactacagtccgtntctagaaagaacaggctccaccancaccaaaggaccaacctccaaacaaaacccaggtacgtaccttaacaatacgaaaccaaatactacggaccctgacgacacagccaacattacttactgttacacgtacttctagttgggtttacggggaagtttacttacgttccccttactttggaactaacgttcgggggacccagggtaactcgtaggtccaccgttccnccgcacgccaccaccgacgaccgacgtcg

SEQ ID NO: 359233 - DNA, 531 bp, Homo sapiens
  misc_feature: GZ8MTXP02H7545.17.33.C11.1.454.CMB.2.raw
  modified_base (314)..(314): a, c, t, g, unknown or other
  misc_feature (314)..(314): n is a, c, g, or t
  modified_base (365)..(365): a, c, t, g, unknown or other
  misc_feature (365)..(365): n is a, c, g, or t
  modified_base (405)..(405): a, c, t, g, unknown or other
  misc_feature (405)..(405): n is a, c, g, or t
  modified_base (453)..(453): a, c, t, g, unknown or other
  misc_feature (453)..(453): n is a, c, g, or t
  modified_base (501)..(501): a, c, t, g, unknown or other
  misc_feature (501)..(501): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggatgggctggatccgtcagccccaggaagcctggagtggcttgcgctcattatgggatgagagtaagcactacagtcgtntctgaagaacaggctcaccataccaaccaaggaccacctccaacaaaaccnggtacgtaccttacaaatgaacccaatatcggacccttgngacacagccacatatactgttacacgctctagtgggttcgggaagttnttacgtccttattgactacgtgggacagggactcgtcgtcaccgttcnccgcagccctcaccgacggccctagtcccg

SEQ ID NO: 359234 - DNA, 522 bp, Homo sapiens
  misc_feature: GZ8MTXP02JFXCW.17.33.C11.1.454.CMB.2.raw
  modified_base (297)..(297): a, c, t, g, unknown or other
  misc_feature (297)..(297): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtacaaacaacaaacactcctggacccctgcccgatctcaggctcccctcttggggcaaagctgccctgacactgtcctggtgtgcagcctgaggacgaggctgactattactgcctactctactttggtggtgctgtgctattcggcggaggaccaagctgaccgtctaagtcagcccaaggctcgccccctggtccacgtctcgttcccaccctcctacccg

SEQ ID NO: 359235 - DNA, 552 bp, Homo sapiens
  misc_feature: GZ8MTXP02HIVQX.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaacaaaacactcctacggaccccctgcccgattcctcacggcctcccccctccgttggggacaaagctcgccctgacactgtctggtgtgcagcctgaggacgaggctgactagttactgcctactcttactttggtggttgctgtgctagttcgggcggtaggaccaagctgtaccgtcttaaagtcacgacccaacggcctcgcccccgtcggtccacgtcctcgttccccgcccttcctcccg

SEQ ID NO: 359236 - DNA, 572 bp, Homo sapiens
  misc_feature: GZ8MTXP02H6PY1.17.33.C11.1.454.CMB.2.raw
  modified_base (293)..(293): a, c, t, g, unknown or other
  misc_feature (293)..(293): n is a, c, g, or t
  modified_base (411)..(411): a, c, t, g, unknown or other
  misc_feature (411)..(411): n is a, c, g, or t
tcagcgtagactagcacgaccggtgctcgatttagagtgagctcgttgggtttgggggcgccagggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttacatccaaactggttccagcagaaacctggacaagcacccaggcactcatttanagtacaaacaacaaaacactcctggacccctgccccgattctcaggctccccctccttggggcaaagctgccctgacactgtctggtgtgcagcctgaggacgaggctgactattacngcctactctactttggtgtgctgtgctagttcggcggagggaccaagcgtacgtaccgtacttaaaggtcaaacggacccaaacgggcctcggtcccccccgtcgggttaccgaaccgttcccttcggtttaccccccaccccgtttaccccctttccccg

SEQ ID NO: 359237 - DNA, 523 bp, Homo sapiens
  misc_feature: GZ8MTXP02I76F7.17.33.C11.1.454.CMB.2.raw
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaaggccctggagtggcttgcgctcatttatgggatgagagtaagcactacagtccgtctctgaagaacaggctccaccatcacaagacacctccacaaaccagtgtccttacaatgaaccaatatggaccctgtgacacagccacatattactgttcacgtctctagttggttcgggagtttattacgtccttatttgactacgtcggggccagggactcgtggtcaccgtctccgcacgcctccaccacggcccagtcccg

SEQ ID NO: 359238 - DNA, 540 bp, Homo sapiens
  misc_feature: GZ8MTXP02GR2DI.17.33.C11.1.454.CMB.2.raw
  modified_base (417)..(417): a, c, t, g, unknown or other
  misc_feature (417)..(417): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaaaggccctggagtggcttgcgctcatttatgggatgagagtaagcactacagtccgtctctgaaagacaggctccaccatcaccaaggaccacctccaacaaaccaggtgtaccttacaatgaaccaatatcggaccctgtacgacacagccanatattactgttcacgtctctagtggttcgggtattattacgtccctatttgactacgtgggaccagggactcgtcgtcaccgtctccgcgacgccctaccgaccgaacggcccacgttcccgg

SEQ ID NO: 359239 - DNA, 575 bp, Homo sapiens
  misc_feature: GZ8MTXP02G90S7.17.33.C11.1.454.CMB.2.raw
  modified_base (542)..(542): a, c, t, g, unknown or other
  misc_feature (542)..(542): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaactcacacagaccctcacgctgacctgcaccttctctggcttctcactcagaacgagtggaatgggagtgggctggatccgtcacgccccaggaacggccctggagtggcttgcgctcatttatggatgagagtaagcactacagtccgtctctagaagaacaggccctcaccatccaccaaggaccaccctccaacaaaccgaggtcgtaccttaacaatcgaaccctaaatacgtacggaccctgtacggaccacacgaccacataattactgttcacgtctacgtaagtgggttacgggagtttacttacgttacccttatttcgacttacgtcgggggaccaggggtaacctcgtacggtccaccgttcnccgcacgtccctaccgaccgaacggccctacgg

SEQ ID NO: 359240 - DNA, 517 bp, Homo sapiens
  misc_feature: GZ8MTXP02FNST7.17.33.C11.1.454.CMB.2.raw
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaagccctggagtggcttgcgctcatttatgggatgagagtaagcactacagtccgtctctgaagaacaggctccaccatcacaagacacctccacaaacaggtgtcctanatgacatanggacctgtgacacagccacatattactgttcacgtctctagtggttcgggattattacgtcctatttgactacgtgggaccagggaactcgtacgtcaccgtctccgcacgcctccaccgaacggcccagttcccg

SEQ ID NO: 359241 - DNA, 556 bp, Homo sapiens
  misc_feature: GZ8MTXP02IRB5Y.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagcccctcactgactgtgtccccaggagggacagtcactctcacctgtgcttccaacactggagcagtcaccagtgcttacatccaaactggttccagcagaaacctggacaagcacccaggcactcatttatagtacaaacaaacaaaacactcctaggacccctgcccgattctcaggctccccctccgttggggcaaagctgccctgacactgtctggtgtgcagcctgagacgaggctagactattactgacctatctacgtttggtggttcgtctgtgcttagttcgggacggtagggaccaagcgtcgtaccgttcttaaacgtcacgcccgaacgggcctccgcccccgtcggtcctacttcctcgttcccctaccctcccttacc

SEQ ID NO: 359242 - DNA, 551 bp, Homo sapiens
  misc_feature: GZ8MTXP02HYL8Z.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctggacaagcacccagggcactcatttatagtacaaacaaacaaacactcctggacccctgcccgatctcaggcctcccctccttggggcaaagctcgccctgacactgtcctggtgtgcagcctgagcgaggctgactattactgcctactcttactttggtcggttgcttgtgctagttcgggcggagggtaccaaagtctcgaccgttcttaaaggtcacgacccaacgggcctcgccccctcggtccaccgttcctcgtttcccccgcccttacctcccg

SEQ ID NO: 359243 - DNA, 552 bp, Homo sapiens
  misc_feature: GZ8MTXP02F6967.17.33.C11.1.454.CMB.2.raw
  modified_base (400)..(400): a, c, t, g, unknown or other
  misc_feature (400)..(400): n is a, c, g, or t
  modified_base (505)..(505): a, c, t, g, unknown or other
  misc_feature (505)..(505): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaaggccctggagtggcttgcgctcatttatgggatgagagtaagcactacagtccgtctctgaagaacaggctccaccatcaccaagacacctccacaaaccaggtcgtaccttacaatgaaccaatatggaccctgngacacagccacatattactgttacacgtctctagtgggttcgggattattacgtcctactttgacttacgtggggacccaggggaactcgtacggtcacccggtntcccggctacggccctacccgaacgaacgggccccaagtttccccgg

SEQ ID NO: 359244 - DNA, 517 bp, Homo sapiens
  misc_feature: GZ8MTXP02H8G0X.17.33.C11.1.454.CMB.2.raw
  modified_base (305)..(305): a, c, t, g, unknown or other
  misc_feature (305)..(305): n is a, c, g, or t
  modified_base (464)..(464): a, c, t, g, unknown or other
  misc_feature (464)..(464): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctggacaagcacccagggcactcatttatagtacaaanaacaaaacactcctggacccctgcccgatctcaggctcccctccttggggcaaagctgccctgacactgtctggtgtgcagcctgaggacgaggctgactattactgcctactctactttggtgtgctgtgctagttcggcggaggccaagctgccgtnttaagtcagtccagcttacgcccctcggtccactcgtctccccacctcctccg

SEQ ID NO: 359245 - DNA, 534 bp, Homo sapiens
  misc_feature: GZ8MTXP02H0AW1.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaagccctggagtggcttgcgctcatttatgggatgagagtaagcactacagtccgtctctgaagaacaggctccaccatcacaagacacctcacaaacagtgtccttacaatgaccaatatgaccctgtgacacagccacatatacttgttacacgtctctagtgggttacgggtattattacgtccttattgacttacgtcggggaccagggtaactcgtcggtccaccgtcctccgaacgcgccctccaccgaacgggccctacgtcccg

SEQ ID NO: 359246 - DNA, 555 bp, Homo sapiens
  misc_feature: GZ8MTXP02IK3S0.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccgtcacgccccaggaacggccctggagtggcttgcgctcatttattgggatggagagtaagcactacagtccgtctctgaaagacaggctccaccatcaccaaggaccacctccaacaaaccaggtcgtaccttacaatagaaccaatactcggaccctgcgacacagccaacatattactgttacacgtctcttagtgggttcggggtagtttacttacgtcccttatttgacttacggtcggggaccgagggaccttcgtcggtccaccgtctccgcacgcctccacgacgggccccatcccgg

SEQ ID NO: 359247 - DNA, 546 bp, Homo sapiens
  misc_feature: GZ8MTXP02GQ4Q2.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaaggccctggagtggcttgcgctcatttatgggatgagagtaagcactacagtccgtctctgaaagaacaggctccaccatcaccaaggaccacctccaacaaaccaggtcgtaccttacaatcgaaccaatatggaaccctgtagacacagaccacatattactgttacacgtctactagtggttcggggtatttagttacgtcccttattgactacgtggggaccagggactcgtcggtccaccgtctccgcacgcctccaccgaacggcccagtcccgg

SEQ ID NO: 359248 - DNA, 568 bp, Homo sapiens
  misc_feature: GZ8MTXP02ILMGM.17.33.C11.1.454.CMB.2.raw
  modified_base (293)..(293): a, c, t, g, unknown or other
  misc_feature (293)..(293): n is a, c, g, or t
  modified_base (336)..(336): a, c, t, g, unknown or other
  misc_feature (336)..(336): n is a, c, g, or t
  modified_base (385)..(385): a, c, t, g, unknown or other
  misc_feature (385)..(385): n is a, c, g, or t
tcagcgtagactagcacgaccggtgctcgatttagagtgagctcgttgggtttggggcgccaggggtcccttccaatatcagcaccatggcctggactcctctctttctgttccttctcacttgctgcccagggtccaattctcagactgtggtgactcaggagccctcactgactgtgtccccaggagggacagtcactctcacctgtgcttccaacactggagcagtcaccagtgcttacatccaaactggttccagcagaacctggacaagcacccaggcactcatttanagtaacaaacaacaaacactcctggaccccctgcccgattccncgagcctcccctccgtggggacaagctcgccctgaccactgtctgggtntgcagctgagacgaggctagacttaatctcgtacctacttcttacgtttggtggttgtcttgtgtccttagttcgggcgggaacgggaccaagctacgaccgttagttaaacgtcacggacccaaggccgtccgcccccgttggtccctaccgttcttccgttaccccctaccttccctaccg

SEQ ID NO: 359249 - DNA, 557 bp, Homo sapiens
  misc_feature: GZ8MTXP02GB5RI.17.33.C11.1.454.CMB.2.raw
  modified_base (425)..(425): a, c, t, g, unknown or other
  misc_feature (425)..(425): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttatgggatgagagtaagcactacagtccgtctctgaaagaacaggctccaccatcaccaagaccacctccacaaaccaggtcgtaccttacaaatcgaaccaaatactcgggaccctggtaggacacagcccaanatattactgttcacgctactagtgggttacggggtattagttacgttccctatttgactacgtggggcaggggactcgtcggttccaccggtctccgcgtacgccctaccaaccgacggcccacgttcccgg

SEQ ID NO: 359250 - DNA, 540 bp, Homo sapiens
  misc_feature: GZ8MTXP02GZROM.17.33.C11.1.454.CMB.2.raw
  modified_base (416)..(416): a, c, t, g, unknown or other
  misc_feature (416)..(416): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgtcagccccaggaagccctggagtggcttgcgctcatttatgggatgagagtaagcactacagtccgtctctgaagacaggctaccacatcaccaaggacacctccaacaaaccaggtcgtaccttaacaatcgaaccaataactggaccctgtcgacacagccanatacttactgttacacgtctctagtggtcgggtattacttacgtccttacttgactacgtcgggccagggactctacggcaccgtctccgcacgcctaccgaccgtaacggccctacgttcccg

SEQ ID NO: 359251 - DNA, 571 bp, Homo sapiens
  misc_feature: GZ8MTXP02JLRPP.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaacaaaacactcctacggacccctgcccgattctcacggctccccctccgttggggacaaacgctacgccctgacactgtctggtgtgcagcctgaggacgaggctagactattactgcctactctacgtttggtggtgctgtgctagtcggcggaggaccaagtcgacgtaccgttagtaacgtccacgacccgaacggtccgtaccgcccccgtcggtcctaaccgttccttccgttaccccctaccccttccctttaccccg

SEQ ID NO: 359252 - DNA, 541 bp, Homo sapiens
  misc_feature: GZ8MTXP02HXQJO.17.33.C11.1.454.CMB.2.raw
  modified_base (170)..(170): a, c, t, g, unknown or other
  misc_feature (170)..(170): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctnactgactgtgtcccaggaggacagtcactctcacctgtgcttcaacactggagcagtcaccagtgcttacatccaaactggttccagcagaaacctggacaagcactcagggcactcatttatagtacaaaacaacaaacactcctcgacccctgcccgattctcacggccctccctccttggggacaaagctgcctgacactgtctggtgtgcagcctgaggacgaggctgactataactgcctacttcttacgtttggtggtgtctgtgctagttcggcggtaggaccaagctcgaccgtcttaacgtcaacgtcccgaacggcctacggcccccgtcggtctaccgtctccgttcccgtcccttcccg

SEQ ID NO: 359253 - DNA, 540 bp, Homo sapiens
  misc_feature: GZ8MTXP02IXO7T.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttatgggatgagagtaagcactacagtccgtctctagaagaacaggctccaccatcaccaagacacctccacaaaccaggtgtccttacaatgaaccaatatgaccctgtgacacagccaacatattactgttcacgtctactagttggtcggggtattattacgtcccttatttgacttacgtcggggccaggggaactcgtcggtccaccgtctccgcacgccctccaccgaacgggcccacgtcccgg

SEQ ID NO: 359254 - DNA, 516 bp, Homo sapiens
  misc_feature: GZ8MTXP02GVNTV.17.33.C11.1.454.CMB.2.raw
  modified_base (404)..(404): a, c, t, g, unknown or other
  misc_feature (404)..(404): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgccgatctcagctcccctctggggcaagctgccctgacactgtctggtgtgcagcctgagacgaggctgactattacngcctactctactttggtgtgctgtgctagttcggcggagggaccaagctgaccgtcttaagtcagccaacggctcgcccctcggtcacgtctcgtcccaccctccttacccg

SEQ ID NO: 359255 - DNA, 698 bp, Homo sapiens
  misc_feature: GZ8MTXP02HFLR5.17.33.C11.1.454.CMB.2.raw
  modified_base (300)..(300): a, c, t, g, unknown or other
  misc_feature (300)..(300): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtcccaggaggacagtcactctcacctgtgcttccaacactggagcagtcaccagtgcttactataccaaactggtccagcaagaaacctggaacaagccaccgaggcactctaatttanaagtaacaaaacaaacaaaacactaccgtacggacccctcgacccgtaattcctacaacggtccctcccccccgttcccggttacgggggaccaaaacggtccttccgccccgttgaacctaacttcggttccgtgggttgtcgaccgaacgcccgtaggacgggaaccggagggccttagaaccttagtttaacctcgtacccttacttaccgtttaacgtttgggtggtttcgtcgttcggtacgtacgttacggtacggggacgggtaacgggaaccgaacgtcgtacgtaccgttacgttaacgaccgtaaccggacccgacggtcccgtacccgtcccccgtcggtaccctaccgttcccgttcccggtcccccgtaccccttcccgtacccg

SEQ ID NO: 359256 - DNA, 546 bp, Homo sapiens
  misc_feature: GZ8MTXP02F1VS1.17.33.C11.1.454.CMB.2.raw
  modified_base (419)..(419): a, c, t, g, unknown or other
  misc_feature (419)..(419): n is a, c, g, or t
  modified_base (438)..(438): a, c, t, g, unknown or other
  misc_feature (438)..(438): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttatgggatgagagtaagcactacagtcccgtctctagaaagaacaggctccaccatcaccaaggaccacctccacaaaccaggtcgtccttaacaatcgaaccaatatcggaccctgtgacacagccanatattactgttcacgtctntagttgggttcgggagtttattacgttccctacttgacttacgtcggggcagggtactcgtcggtcctaccgtctccgcacgcctaccaccgacggcccacgtcccgg

SEQ ID NO: 359257 - DNA, 669 bp, Homo sapiens
  misc_feature: GZ8MTXP02H0IHM.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaacgccctggagtggcttgcgctcatttagtggatgagagtaagcactacagtcgtctctagaaagacaggctccaccatacaccgaagaccacctccaacaaacaggtcgtaccttacaatcgaaccctaatacgtacggaccctggtacggaacacgacgaccctaactattaacttacttacggtttacaacggttccttacgttaacggttcggggtttacgggggtaacgttttaacgtttacggtttaccccttaacgtttttcgaaacgttaccggttacgggggacccgtagggggtaaaccttcggtacgggttacccgaacccgttccgttcccggaaccgtaccggaccccttaccccggaaccgtaaacccggggcccctaacgttcccccggg

SEQ ID NO: 359258 - DNA, 541 bp, Homo sapiens
  misc_feature: GZ8MTXP02GHONG.17.33.C11.1.454.CMB.2.raw
  modified_base (364)..(364): a, c, t, g, unknown or other
  misc_feature (364)..(364): n is a, c, g, or t
  modified_base (386)..(386): a, c, t, g, unknown or other
  misc_feature (386)..(386): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaagccctggagtggcttgcgctcatttattgggatgagagtaagcactacagtccgtctctgaagaacaggctccaccatcaccaagacacctccacaaacnggtcgtcctacatgaccaatangaccctgtcgacacagccacatattactgttcacgtctctagtggttacgggtagtttacttacgttcccttatttcgacgttacgtcggggaccagggaactcgtcggtccaccgttctccgcgacgcctccgaccgaacggccctagttcccg

SEQ ID NO: 359259 - DNA, 549 bp, Homo sapiens
  misc_feature: GZ8MTXP02G9EER.17.33.C11.1.454.CMB.2.raw
  modified_base (294)..(294): a, c, t, g, unknown or other
  misc_feature (294)..(294): n is a, c, g, or t
tcagcgtagactagcacgaccggtgctcgatttagagtgagctcgttgggtttgggggcgccaggggtcccttccaatatcagcaccatggcctggactcctctctttctgttcctcttcacttgctgcccagggtccaattctcagactgtggtgactcaggagccctcactgactgtgtccccaggaggacagtcactctcacctgtgcttccaacactggagcagtcaccagtgcttactatccaaactggttccagcagaaacctggacaagcaccaggcactcatttanagtacaaacaacaaacactcctggacccctgcccgattctcaggcctccccctccgttggggcaaagctgccctgacactgtctggtgtgcagcctgaggacgaggctgactattactgcctactcttacgtttggtggttgctgtgcttagttcgggcggtaggaccaagcgtacggtaccgtacgttaagtccacgcccgaacggcctccgcccccgtcggtccacgtcctcgttccccgtccctccttcccg

SEQ ID NO: 359260 - DNA, 518 bp, Homo sapiens
  misc_feature: GZ8MTXP02GWC6C.17.33.C11.1.454.CMB.2.raw
  modified_base (411)..(411): a, c, t, g, unknown or other
  misc_feature (411)..(411): n is a, c, g, or t
  modified_base (509)..(509): a, c, t, g, unknown or other
  misc_feature (509)..(509): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtacaaacaacaaaacactcctggacccctgcccgattctcaggctccccctcctggggcaaagctgccctgacactgtctggtgtgcagcctgaggacgaggctgactattacngcctactctactttggtggtgctgtgctattcggcggaggaccaagctgaccgtcttaagtcagcccaagcctcgccccctggtcactctcgtacccnccctcctcc

SEQ ID NO: 359261 - DNA, 523 bp, Homo sapiens
  misc_feature: GZ8MTXP02JV0RR.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaacaaaacactcctggacccctgcccgattcctcaggctccccctccttggggcaaagctcgccctgacactgtctggtgtgcagcctgaggacgaggctgactattactgcctactctactttggtggtgctgtgcttagttcggcggaggaccagctgaccgtcttaagtcagcccaagctcgccccctggtcactcgtcgtcccgccctctccg

SEQ ID NO: 359262 - DNA, 539 bp, Homo sapiens
  misc_feature: GZ8MTXP02GP4F8.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaggccctggagtggcttgcgctcatttatgggatgagagtaagcactacagtccgtctctgaaagacaggctccaccatcaccaaggacacctccaacaaaccaggtcgtaccttacaatgaaccaatatcggaccctgtggacacagccacatattactgttcacgtctctagtgggttcggggattattacgtccttattgactacgtggggaccagggactcgtcggtcaccgtcgtccgcacgcctaccgaccgaacggcccacgttcccgg

SEQ ID NO: 359263 - DNA, 509 bp, Homo sapiens
  misc_feature: GZ8MTXP02IA5TH.17.33.C11.1.454.CMB.2.raw
  modified_base (317)..(317): a, c, t, g, unknown or other
  misc_feature (317)..(317): n is a, c, g, or t
  modified_base (377)..(377): a, c, t, g, unknown or other
  misc_feature (377)..(377): n is a, c, g, or t
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaagccctggagtggcttgcgctcatttatgggatgagagtaagcactacagtccgtntctgaagaacaggctcaccatcacagacacctcacaaacagtgtctacaatgaccaatanggacctgngacacagccanatatactgttcacgtctctagtggttcgggattattagtcccttattgtactactggggccagggaactcgtacggtcaccgtctccgcacgcctacaccaacggccatcccg

SEQ ID NO: 359264 - DNA, 618 bp, Homo sapiens
  misc_feature: GZ8MTXP02JVOHH.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaaccccacacagacccctcacgctgacctgccaccttctctggcttctcactcagaacgagtggaatggggagtgggctggatccgtcacgcccccaggaacggccctggagtggcttgcgctctatttagtgggatgagagtaagcactacagtccgtctctagaaagaacaggctacccaccatccaaccgaacgaccaccctccaaaccaaaccgtaggtcgtacccttaacaaattacgaacctaaatacgtacggaccctggtacggacacgacgacccactattacttactgttaccacgtcttcgtagttgggttacggggtatttacgttacgttcccttacgtttcgaacgttacggtcgggggaccctaggggtacctcgtacggtccacccggttctccgcacgtccctacccgaccgaacggccctacgttccccgg

SEQ ID NO: 359265 - DNA, 598 bp, Homo sapiens
  misc_feature: GZ8MTXP02GYZP2.17.33.C11.1.454.CMB.2.raw
  modified_base (301)..(301): a, c, t, g, unknown or other
  misc_feature (301)..(301): n is a, c, g, or t
  modified_base (413)..(413): a, c, t, g, unknown or other
  misc_feature (413)..(413): n is a, c, g, or t
tcagcgtagactagcacgaccggtgctcgatttagagtgagctcgttgggtttgggggcgccagggggtcccttccaatatcagcaccatggcctggactcctctctttctgttcctcctcacttgctgcccagggtccaattctcagactgtggtgactctaggagccctcactgactgtgtccccaggagggacagtcactctcacctgtggcttccaacactggagcagtcaccagtgcttactatccaaactggttccagctagaaacctggacaagcacccaggcactcgatttanagtacaaacaacaaacactcctggaccctgcccgatctcaggtctcccctctggggcaaagctgccctgacactgtctggtgtgcagcctgagacgaggctgacctattacngacctactcttactttggtgtgcttgtcgctagttccggagggagggtaccaaaggtctacggtaaccgttacgtttaaagttccgaggtaccccgaaaaggggtccgtacggtaccccccgttaacggggtcctaaaccggttccttccggtttaccccctaacccgtttcccgtttaaccccg

SEQ ID NO: 359266 - DNA, 517 bp, Homo sapiens
  misc_feature: GZ8MTXP02JDWU9.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaaggccctggagtggcttgcgctcatttattgggatgagagtaagcactacagtccgtctctgaagaacaggctccaccatcaccaaggacacctcacaaacaggtgtccttacatgaaccaatatggaccctgtgacacagcacatatactgttcacgctctatggttcgggagttattagtccctatttgactacgtggggccagggacctgtaggtcaccgtctccgcacgcctccacacggcccagtcccg

SEQ ID NO: 359267 - DNA, 551 bp, Homo sapiens
  misc_feature: GZ8MTXP02G67A0.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaaacctggacaagcacccaggcactcatttatagtaacaaacaaacaaaacactcctacggacccctgcccgattctcaggcctccccctccgtggggcaaagctcgccctgacactgtctggtgtgcacgcctggaggacgaggctgactattactgcctactctactttggtggtgcgtgtgtctagttcggcggtacgggaccaagcgtcgtaccgttattaacgtcacgacccgaacggcctccgcccctcggtcctacgtctccgtcccgtccctcctacccg

SEQ ID NO: 359268 - DNA, 573 bp, Homo sapiens
  misc_feature: GZ8MTXP02GP25P.17.33.C11.1.454.CMB.2.raw
  modified_base (295)..(295): a, c, t, g, unknown or other
  misc_feature (295)..(295): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttanagtacaaacaacaaacactcctggacccctgcccgattctcacggctccccctccgttggggcaaagctgccctgacactgtctggtgtgcagcctgaggacgaggctgactattactgcctactctactttggtggtgcttgtgcgttagttcgggcggtaacgggaccaagcgtacggtaaccgttcgtttaaagtccgaacgaccccaaacggcctccggcccccgtcgggtcccaaccgttccgttccgttcccccggccccttcctttccccg

SEQ ID NO: 359269 - DNA, 531 bp, Homo sapiens
  misc_feature: GZ8MTXP02INTB0.17.33.C11.1.454.CMB.2.raw
  modified_base (186)..(186): a, c, t, g, unknown or other
  misc_feature (186)..(186): n is a, c, g, or t
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
  modified_base (407)..(407): a, c, t, g, unknown or other
  misc_feature (407)..(407): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctnacgctgaccctgcaccttctctggcttctcactcagaacgagtggaatggggagtgggctggatccgtcagccccaggaaacggccctggagtggcttgcgctcatttatgggatgagagtaagcactacagtcccgtctctagaagacaggctccaccatcaccaagaccacctccacaaacaggtcgtcctanatnacanatgacctgtgacacagcanatattactgttcacgtctctagtcggttcgggtattattacgtcccttatttcgacttacggtcggggaccagggactcgtcgtccaccgtctccgcacgcctccgacgacggcccagttcccg

SEQ ID NO: 359270 - DNA, 527 bp, Homo sapiens
  misc_feature: GZ8MTXP02H7ELK.17.33.C11.1.454.CMB.2.raw
  modified_base (415)..(415): a, c, t, g, unknown or other
  misc_feature (415)..(415): n is a, c, g, or t
  modified_base (472)..(472): a, c, t, g, unknown or other
  misc_feature (472)..(472): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaaacactacctggacccctgcccgattctcaggctccccctccttggggcaaagctgccctgacactgtctggtgtgcagcctgaggacgaggctgactattacngcctactctactttggtggtgctgtgcttattcggcggagggaccaagctgaccgtnttaagtcacgcccaggctcgccccctcggtcacgtctcgttcccaccctcctccc

SEQ ID NO: 359271 - DNA, 666 bp, Homo sapiens
  misc_feature: GZ8MTXP02JUSSL.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccgaggaaaggccctggagtggcttgcgctcatttatgggatgagagtaagcactacagtcctctctgaagaacaggctaccaccatcaccaaggaccacctccaacaaaccaggtacgtaccttacaaatcgaaccaaatacgtacggaccctggtcggaaccacgaacgacccaacattactttaaactcgtttaccgaaccgtctttaaccgtagttacggggtttaccgggggttaggtttaactttacggttccccctttagtttacgaacgttaacgttcgggggacccctaagggggtaacccttcgtaacgggttcccgtaacccggtccttacccgggcctaacccggcccttacccccgaaaccgtaaaccgggggccccctaaacgtttccccccgggg

SEQ ID NO: 359272 - DNA, 542 bp, Homo sapiens
  misc_feature: GZ8MTXP02JSTXS.17.33.C11.1.454.CMB.2.raw
  modified_base (370)..(370): a, c, t, g, unknown or other
  misc_feature (370)..(370): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtcccgtctctgaaagaacaggctccaccatcaccaaggacacctccacaaaccnggtgtccttacaatgaaccaatatggaccctgtgacacagcctacatattactgttcacgtctctatggttacggggtagttattagtcctactttacgtactacgtcgggaccgagggtaacgtctcggtcaccgtctccgccgcgcccaccaccgaccggcctacgtccg

SEQ ID NO: 359273 - DNA, 584 bp, Homo sapiens
  misc_feature: GZ8MTXP02JEVRO.17.33.C11.1.454.CMB.2.raw
  modified_base (426)..(426): a, c, t, g, unknown or other
  misc_feature (426)..(426): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcagcccccaggaaaggccctggagtggcttgcgctcattatggatgagagtaagcactacagtccgtctctgaagaacaggctccaccatcaccaaggaccacctccacaaaccgaggtgtaccttacaaatgaaaccaatactagaccctgtagacacagaccacatattacngttacacgtctcgtagtggttacggggtatttacgttaggttcccttacgtttagtacctaacgttcgggggacccaagggggtaacctcgttacggggtcctacccgtcgttcccgcgacgtccctacccaccgaaccggggcccacgtttccccgg

SEQ ID NO: 359274 - DNA, 528 bp, Homo sapiens
  misc_feature: GZ8MTXP02HIKFB.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggttccagcagaaacctggacaagcacccaggcactcatttatagtacaaacaacaaacactcctggacccctgcccgattctcagctcccctcttggggcaaagctcgccctgacactgtctgtgtgcagcctggagacgaggctgactatactgcctactctactttggtgtgctgtgcgtagttcggcggtagggaccaagctacgaccgtctaaagtcaacggcccaaggcctccgccccctcggtcactctcgttccccaccttcctcccg

SEQ ID NO: 359275 - DNA, 638 bp, Homo sapiens
  misc_feature: GZ8MTXP02HDE3X.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaacggccctggagtggcttgcgctcatttattgggatgagagtaagcactacagtccgtctctgaaagaacaggctaccaccatcaaccaaggtaccacctccaaacaaaccagggtacgtaccttaacaaatacgaaccaatagtacggaccctgacgacacacgacctaacatattacctgttaccaacgtctacgttaagtgggtttacgggggtatttattacggttaccctttaagttttcgaacgtttacggtcgggggacccgtaagggggtaaaccttcggttacgggtccccaaacccggtttcccgtacccgaaccgtacccgtacccctacccgaaccggtaaccggtcccctaacggttccccg

SEQ ID NO: 359276 - DNA, 507 bp, Homo sapiens
  misc_feature: GZ8MTXP02GHLJ6.17.33.C11.1.454.CMB.2.raw
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaagccctggagtggcttgcgctcatttattgggatgagagtaagcactacagtccgtctctgaagacaggctcacatcacaagacacctccacaaacaggtgtccttacaatgaccaatatggaccctgtgacacagccacatattactgttcacgctctatggttcggggattattagtccctatttgactactgggccagggactctggcaccgtctcgcacgcctcaccaacggcccatcccgg

SEQ ID NO: 359277 - DNA, 525 bp, Homo sapiens
  misc_feature: GZ8MTXP02HU4IC.17.33.C11.1.454.CMB.2.raw
  modified_base (386)..(386): a, c, t, g, unknown or other
  misc_feature (386)..(386): n is a, c, g, or t
  modified_base (413)..(413): a, c, t, g, unknown or other
  misc_feature (413)..(413): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaaacactcctggacccctgcccgattctcaggctccccctccgttggggcaaagctcgccctgacactgtctgtgtncagctgaggacgaggctgactattacngcctactcttactttggtgtgctgtgtctagttcggcggtagggaccaagctgaccgtcttaaaggtcacgcccaacggctcgcccctcgtcactctcgtcccacctcctcc

SEQ ID NO: 359278 - DNA, 527 bp, Homo sapiens
  misc_feature: GZ8MTXP02HT5HZ.17.33.C11.1.454.CMB.2.raw
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
  modified_base (488)..(488): a, c, t, g, unknown or other
  misc_feature (488)..(488): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatggggagtgggctggatccgtcagcccccaggaaggccctggagtggcttgcgctcatttattgggatgagagtaagcactacagtccgtctctgaaagaacaggctccaccatcacagacactccacaaacngtgtctacatnacatangacctgtgacacagccacatacttactgttcacgtctctagtgggttcgggagttattacgtccttacttgactacgtcgggtcagggactcgtcggtcaccgtcnccgtcgacgcctaccgaccgtaacggcccacgttcccgg

SEQ ID NO: 359279 - DNA, 517 bp, Homo sapiens
  misc_feature: GZ8MTXP02I96A3.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtggctggatccgtcagccccaggaagccctggagtggcttgcgctcatttatgggatgagagtaagcactacagtccgtctctgaagaacaggctccacatcaccaagacactccaacaaacagtgtccttacaatgaaccaatatcgaccctgtgacacagcacatatactgttcacgctctagtggtacggattatacgtccctattgactacgtcgggcagggactcgtaggtcaccgtctccgcgacgccctacaccgacggccctagttccccgg

SEQ ID NO: 359280 - DNA, 632 bp, Homo sapiens
  misc_feature: GZ8MTXP02GD4MF.17.33.C11.1.454.CMB.2.raw
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtggggctggactaccggcgacgaccccaggaacgccctggagtggctgcgctcatttatgggatgagagtaagcactacagtccgtatcgtagaaagacaggtcnccacancaaccaaggaccacctccgaacaaacccgtagggttcgtacccttaaacaacgtacgaaacctaattacgtaccggtacctagtacgaacacacgtaccaactattaacgttactcgtactaccgtcttacgttaggtagggttacgggtagtttacgtaccgttaccttagttacgtacgtacggtacggggtaccgtaagggtacctcgtacggtaccctaccggtcctaccgtaaccgtaccgtacccgtacccgaaccgaccggtaccgtaccgtcccg

SEQ ID NO: 359281 - DNA, 605 bp, Homo sapiens
  misc_feature: GZ8MTXP02IBAZC.17.33.C11.1.454.CMB.2.raw
  modified_base (225)..(225): a, c, t, g, unknown or other
  misc_feature (225)..(225): n is a, c, g, or t
  modified_base (300)..(300): a, c, t, g, unknown or other
  misc_feature (300)..(300): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
tcagcgtagactagcacgaccggtgctcgatttagagtgagctcgttgggttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactataccaaactggttccagcaagaaacctggacaagccacccgaggcactctatttanagtaacaaacaacaaacactcacggaccctgcccgatctcacggcctcccccgtcgtggggcaagctcgccctgacnctgtctgtgncacgtccaggacgacgagctgacttatactcgtcctactcttacgtttggtgttgcttgtgcgttacgttcgggacggaacggggaacccaaggtccgtacggtaccgttacgtttaaacgacaaccggacccgtaacgcccgttaccgcccccgttccggttaacctacccgttcccgttcccggtttcccccgtacccccgtttacccgttccccg

SEQ ID NO: 359282 - DNA, 556 bp, Homo sapiens
  misc_feature: GZ8MTXP02F7C93.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtggggctggatccgtcacgccccaggaacggcctggagtggctgcgctcatttatgggatgagagtaagcactacagtccgtctctagaaagaacaggctaccaccactcaaccaaggaccacctccaacaaacccaggtacgtaccttaacaaatgaaaccaaatactacggaccctgtacgacacagccacatacttactgtcacgtctctagtggttacgggtatttattacgtccttacttgactacgtcgggacctagggactcgtacggtcctaccgtctccgcacgccctccacgaacggcctacgtcccgg

SEQ ID NO: 359283 - DNA, 534 bp, Homo sapiens
  misc_feature: GZ8MTXP02IR5AC.17.33.C11.1.454.CMB.2.raw
  modified_base (295)..(295): a, c, t, g, unknown or other
  misc_feature (295)..(295): n is a, c, g, or t
  modified_base (396)..(396): a, c, t, g, unknown or other
  misc_feature (396)..(396): n is a, c, g, or t
tcagcgtagactagcacgaccggtgctcgatttagagtgagctcgttgggtttggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtacaaacaacaaacactcctggacccctgcccgatctcaggctccccctccgtggggcaaagctgccctgacactgtctggtgtgcagcctgaggacgnggctgactattactgcctactctacttggtcggtgtctggtcgctagttcggcggtagggaccaagctgaccgtctaaagtcacgcccgaagcctcgccccctggtccaccgtctccgttccccgccctccttacccg

SEQ ID NO: 359284 - DNA, 534 bp, Homo sapiens
  misc_feature: GZ8MTXP02HJ624.17.33.C11.1.454.CMB.2.raw
  modified_base (290)..(290): a, c, t, g, unknown or other
  misc_feature (290)..(290): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggtccagcagaacctgacagcaccaggcactcatttanagtacaaacaacaaacactcctggacccctgcccgatctcacgctccccctccgtggggcaaagctcgccctgacactgtctggtgtgcagcctgagacgagctagactattactgcctactctacgtttggtggttgcgtgtgtctagttcggcggaggaccaaggctcggtaccgttacttaacgtcacgacccaacggcctcgccccgtcggtccactctcgtccccacccttcctacccg

SEQ ID NO: 359285 - DNA, 575 bp, Homo sapiens
  misc_feature: GZ8MTXP02HWY0O.17.33.C11.1.454.CMB.2.raw
  modified_base (323)..(323): a, c, t, g, unknown or other
  misc_feature (323)..(323): n is a, c, g, or t
  modified_base (334)..(334): a, c, t, g, unknown or other
  misc_feature (334)..(334): n is a, c, g, or t
  modified_base (538)..(538): a, c, t, g, unknown or other
  misc_feature (538)..(538): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgtcagcccccaggaacggccctggagtggcttgcgctcatttattgggatgagagtaagcactacagtccgtntctgaagaacnggctccaccatcaaccaaggaccacctccaaacaaaaccgaggtcgtaccttaacaatcgaaccaatatcggaccctggtgaacacagcccaacatacttactgttacacgtctactagtgggttcgggtagttattacgtaccttactttgacttacgtcgggggaccctaagggggaacttcgtcggtccgaccggttcccncgccgacgtccctaccaccgaaccggccctacgtccg

SEQ ID NO: 359286 - DNA, 629 bp, Homo sapiens
  misc_feature: GZ8MTXP02I1S5P.17.33.C11.1.454.CMB.2.raw
  modified_base (320)..(320): a, c, t, g, unknown or other
  misc_feature (320)..(320): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtcgaaaacccacacagacccctcacgctgacctgccaccttctctgcttctcactcaagaacgagtggaagtgggagtgggctggactccggtcacgccccaggaacgccctggagtggctgcgctcatttagtgggatgagagtaagcactacncgtccgtctcgtagaaagaacgaggcctacccgaaccactaccaaaccgaaacggaaccaaccctacccaaacgtaaaaccgacggttaccggtacccttaaacaaacgtacgaaaccctaaatacgtacggacccctaggtacggaaccacgaacacccaactactaactttactgttccacgtcttacgtagttgggttacgggtagttaacgttacgtccctttagttacgactacgttcggggactagggtacctcgtcggtccaccgtctccgctacgccctacaccgtacggcctacgtcccg

SEQ ID NO: 359287 - DNA, 619 bp, Homo sapiens
  misc_feature: GZ8MTXP02IGCOI.17.33.C11.1.454.CMB.2.raw
  modified_base (332)..(332): a, c, t, g, unknown or other
  misc_feature (332)..(332): n is a, c, g, or t
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaggccctggagtggcttgcgctctatttagtgggatgagagtaagcactacagtccgtctctgaagaacnggctccaccatcaccaagacacctcacaaacaggtcgtcctanatgacanatgacctgtgacacagccacatattactgttacacgtcttactagttcgggttaccggggtatttacgtttacggttcccctttaagttttcgaacccgttacggttacgggggaccctaaacgggggtaaacctttccggtacgggtttacccaaccccgggttcctacccggccgaaaccggtccccttaccccgaacccggtaaacccggggcccctaacggtttccccccggg

SEQ ID NO: 359288 - DNA, 542 bp, Homo sapiens
  misc_feature: GZ8MTXP02HAJ8U.17.33.C11.1.454.CMB.2.raw
  modified_base (320)..(320): a, c, t, g, unknown or other
  misc_feature (320)..(320): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaggccctggagtggcttgcgctcatttattgggatgagagtaagcactacagtccgtntctgaaagaacaggctccaccatcaccaaggacacctccaacaaacaggtcgtaccttacaatgaccaatatcggaccctgtgacacagccacatattactgttcagtctctagtggttacgggagtttacttacgtcctactttgacgtacgttcggggaccagggtaactcgtggtcctaccgtctccgcacgtcctccgaccgacggcccaagtcccgg

SEQ ID NO: 359289 - DNA, 557 bp, Homo sapiens
  misc_feature: GZ8MTXP02F1UOI.17.33.C11.1.454.CMB.2.raw
  modified_base (298)..(298): a, c, t, g, unknown or other
  misc_feature (298)..(298): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtcaccagtgcttactataccaaactggttccagcagaaacctggacaagcacccaggcactcatttanagtacaaacaaacaaaacactcctcggaccccctgccccgtattctcacggcctccccctccgttggggacaaagctcgccctgacactgtctggtgtgcagcctgaggacgagctgactattactgacctactcttacgtttggtggttgcgttgtgtctagtcgggtcggagggaccaagctgaccgtcgttaagtcgacgtcccgaaggcctccgcccccgtcggtccacgttctcgttccccgccctccttcccg

SEQ ID NO: 359290 - DNA, 584 bp, Homo sapiens
  misc_feature: GZ8MTXP02GGKU9.17.33.C11.1.454.CMB.2.raw
  modified_base (391)..(391): a, c, t, g, unknown or other
  misc_feature (391)..(391): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaacggccctggagtggcttgcgctcatttatgggatgagagtaagcactacagtccgtctctagaaagaacaggctaccaccatacaaccaaggaccaacctccaacaaaaccgaggtcgtaccttaanaaactcgaaccaaatactacggaccctgtacgacacagccaacatattactgttcacgtctactagtggttacggggagtttagttacgttcccttatttagacttacggtcggggacctaggggtacctcgtcggtcctaccgtcctccggaactacgaccctaccgaaccgaacggccctaacgttcccgg

SEQ ID NO: 359291 - DNA, 650 bp, Homo sapiens
  misc_feature: GZ8MTXP02G0IRB.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcacgcccccgaggaaacggccctggagtggcttgcgctctatttagtgggatgagagtaagcactacagtccgtctctagaaagacaggctacccacatacaaccaaaggaccaccctccaaaccaaaaccgacgggtacgtaccttaacaaatcgaaaccctaatacgtacggaccctggtacgacacacgaccaacatattactgttacacgtctcgtagtgggttacgggtagtttagttacgtacccttacgtttacgaacgttacgtacgggggaccgtaaacggggtaaccttcggtacggtacccgtaacccggttcccgtcccggaacctaccggtcccccttacccggaaacccggtaaaccggggccccctaacggtttccccccggg

SEQ ID NO: 359292 - DNA, 664 bp, Homo sapiens
  misc_feature: GZ8MTXP02GXHVW.17.33.C11.1.454.CMB.2.raw
  modified_base (325)..(325): a, c, t, g, unknown or other
  misc_feature (325)..(325): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaacggccctggagtggcttgcgctctatttatttggatgagagtaagcactacagtccgtntcgtagaaagaacaggctaccaccatacaccaaggaccaacctccaaacaaaccaggttcgtacccttaacgaaatacgaaccctaaatactacggaaccctggtacggaaccacgacgacccaactacttaactttaacctggtttaccaaccggtcttaccgttaggttacgggggtttaccgggggtagttttaacgtttaccggttacccctttaacgtttacggtaaccttacggttacgggggacccgtaagggggtaaccttcgtacgggtaccctaccgtccgtcccgctaccggtccctaccgaaccgaaccgggccctacgttccccgg

SEQ ID NO: 359293 - DNA, 554 bp, Homo sapiens
  misc_feature: GZ8MTXP02H08JA.17.33.C11.1.454.CMB.2.raw
  modified_base (329)..(329): a, c, t, g, unknown or other
  misc_feature (329)..(329): n is a, c, g, or t
  modified_base (390)..(390): a, c, t, g, unknown or other
  misc_feature (390)..(390): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttccaacactggagcagtcacagtgcttaactatccaaactggtccagcagaaacctggacaagcaccaggcactcatttatagtaacaaacaaacaaacactactcggaccctnccgatctcagctcccctcgttggggacaaagctacgccctgacactcgtctggtgtgacgngtccagaggacgaggctagactattacgtcacctacttacttacgtttggtggtcgtgtgtgcttagttcggcggagggaccaagctcgacgttacttaaacggcacgaccaacggcttccggcccctcggtctacctcgtccgttccccgcccttcccttccg

SEQ ID NO: 359294 - DNA, 722 bp, Homo sapiens
  misc_feature: GZ8MTXP02IO9HX.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaatgggagtgggctggatccgtcacgccccaggaacggccctggagtggcttgcgctctatttagtgggatggagagtaagcactacacgtccgtctctagaaagaacaggcctaccaccactaccaaccgaaacggaccaaccctacccaaaccgaaaaccgtacgggttaccgttacccttaaacgaaacttacgaaaccctaaagttacgtaccggaacccctaggtaccggaaccaacacgacccaactacttaactttacgtcgtttaccaacgttcttacgttaggttacggggttaccggggttaatttacgtttaccggtccctttaaacgtttcgtaaccgttacggttcggggtacccgtaagggggtaacccttcggttaccgggttacccgtaccccggttaccgtcccggtaaccgacccgtaccccgttaccccgaaaccccggtaaaccggggtcccccttaacggtttcccccggg

SEQ ID NO: 359295 - DNA, 582 bp, Homo sapiens
  misc_feature: GZ8MTXP02F87MM.17.33.C11.1.454.CMB.2.raw
  modified_base (381)..(381): a, c, t, g, unknown or other
  misc_feature (381)..(381): n is a, c, g, or t
  modified_base (518)..(518): a, c, t, g, unknown or other
  misc_feature (518)..(518): n is a, c, g, or t
  modified_base (544)..(544): a, c, t, g, unknown or other
  misc_feature (544)..(544): n is a, c, g, or t
tcagcgtagactagcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgttcccatcgactacgcctttcggcctcgccttaggggtcactcaccctgccccgattaacgtggacaggaacccttggtcttccggcgagcgggcttttcaccgtntttatcgttacttatgtcagcattcgctacttctgacttaccctccagccatcgccctcacagcacaccttcacagcttacagaaccgcctacccctaccaacaacgcaactaagcgtcgctgccgcacgcttcggngctagttcggtttacgccccgtttanacttccttccccgactacttctacgtaccttagtaccg

SEQ ID NO: 359296 - DNA, 522 bp, Homo sapiens
  misc_feature: GZ8MTXP02JJDCB.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgtcagccccaggaaggccctggagtggcttgcgctcatttattgggatgagagtaagcactacagtccgtctctgaagaacaggctcaccatcacaagacactccacaaaccagtcgtccttacaatgaaccaaatatacggaccctgtggacacacgccacatattactgttcacgctctagtggttcgggattatacgtcctattgactacgtgggccagggactcgtgtcaccgtctccgcacgcctccaccgaacggcccagtcccgg

SEQ ID NO: 359297 - DNA, 676 bp, Homo sapiens
  misc_feature: GZ8MTXP02I8YUQ.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaacgccctggagtggcttgcgctcatttatgggatgagagtagcactacagtccgtctctagaagaacaggctaccaccatcaaccaaggaccacctccaacaaaccgaggtacggtacccttaacaaatcggaaacccaaattacgtcgggacccctaggtacggaacacacgaccctaacattacttaacgtcgtttaccacgtcttacttagttcggggttacgggggtatttacgtttacggttaccctttactttacgaaccgttacggtacgggggtaccctaaagggggtaaccctttccggttcggggttaccctaacccgggttcccttaccccggccgaaaccggtcccccttaccccgaaacccggtaaaccgggggcccccttaacggtttccccccggg

SEQ ID NO: 359298 - DNA, 531 bp, Homo sapiens
  misc_feature: GZ8MTXP02G26BO.17.33.C11.1.454.CMB.2.raw
  modified_base (319)..(319): a, c, t, g, unknown or other
  misc_feature (319)..(319): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccatcagccccaggaaaggccctggagtggctgcgctcatttatgggatgagagtaagcactacagtccgtntctgaagaacaggcctacaccatcacaacggacaccctccaacaaaccaggtggtaccttaacaatacgaccaaatatggaccctgtgacacagcacatattactgttcacgctctatgttgggaggttattagtcctacttagtactactgggtcgacggaacgtacgtcgtcgtaccgtctccgcacgacaccaccaacggaccgtaccg

SEQ ID NO: 359299 - DNA, 525 bp, Homo sapiens
  misc_feature: GZ8MTXP02IC7CG.17.33.C11.1.454.CMB.2.raw
  modified_base (204)..(204): a, c, t, g, unknown or other
  misc_feature (204)..(204): n is a, c, g, or t
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
  modified_base (402)..(402): a, c, t, g, unknown or other
  misc_feature (402)..(402): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttcnctggcttctcactcagaacgagtggaatgggagtggggctggatccgtcagcccccaggaaaggccctggagtggcttgcgctcatttattgggatgagagtaagcactacagtccgtctctgaaagaacaggctccaccatcacagacacctcacaaacnggtgtcctanatgaccaanatcgacctgtgacacganccacatattactgttcacgtctctatgggttcgggagtttattcgtcccttattgactacgtgggccgagggactgtacggtcaccgtctccgcacgtccaccgacgacgggccctagtcccg

SEQ ID NO: 359300 - DNA, 733 bp, Homo sapiens
  misc_feature: GZ8MTXP02G6LKX.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaacggccctggagtggcttgcgctctatttagtggatgagagtaagcactacacgtcccgtctcgtagaaacgaacgacggtctacccgacccactaccaaacccaacggaacccacccgtacccaaaccaaaacccgtaggggttaccggttaccctttaaacaaacgttacgaaacccaaagttacgtacggaccccttaggtacggaacaccgacgacccaactacttacttaaccgtggtttaccaacggttccttaccgttaggttacggggtttaccgggggttaacgtttaacgtttaccggttaccctttacgttttacggaaccttaaccgggtacgggggtacccgtaagggggtaaacccttcggttacggttacccgtaacccgtttcccgcccggtaaccaaccggtccccttacccgaaacccggtaaccggggtacccctaacggtttcccccgg

SEQ ID NO: 359301 - DNA, 478 bp, Homo sapiens
  misc_feature: GZ8MTXP02HR8U7.17.33.C11.1.454.CMB.2.raw
  modified_base (184)..(184): a, c, t, g, unknown or other
  misc_feature (184)..(184): n is a, c, g, or t
  modified_base (302)..(302): a, c, t, g, unknown or other
  misc_feature (302)..(302): n is a, c, g, or t
  modified_base (328)..(328): a, c, t, g, unknown or other
  misc_feature (328)..(328): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (403)..(403): a, c, t, g, unknown or other
  misc_feature (403)..(403): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctnacgctgacctgcaccttctctggcttctcactcagaacgagtggaatggggatgggctggatccgtcagccccaggaaagccctgagtgctgcgctcattattggatgagagtaaganactacagtcgtctctgaagaacagcncacatcacagacacncacaaacagngtctacaananacananagacngnganacanacacatatatntcacnctntagtgtggtagtatactctactatactacgcgacgagacgctcgtcgactcncncgacacacacgacgacactcg

SEQ ID NO: 359302 - DNA, 577 bp, Homo sapiens
  misc_feature: GZ8MTXP02IS9CL.17.33.C11.1.454.CMB.2.raw
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgaccctgcaccttctctggcttctcactcagaacgagtggaatgggagtgggctggatccgtcagccccaggaaagccctggagtggcttgcgctcatttatgggatgagagtaagcactacagtccgtctctgaagacaggctcaccatcacaagacactccanaaacagtgtcctanaatgaccatatgacctgtcgacacagccaacatacttactgttcacgtctactagtggttacggggtatttagttacggtccttaacgtttgaaccgttacgtacgggggtacccgaaaggggtaacctcgttcgggtaccgtacccggtcttcccggcgaccggcccttacccgaccgaaaccgggtccccaacgtttcccccggg

SEQ ID NO: 359303 - DNA, 554 bp, Homo sapiens
  misc_feature: GZ8MTXP02FW69G.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaaggccctggagtggcttgcgctcatttatgggatgagagtaagcactacagtccgtctctagaagaacaggctccaccatcaccaagaccacctccaacaaacaggtcgtaccttacaatgaaccaatatcggaccctgtgacacagccacatattactgttacacgtcttctagttgggttacggggagtttattacgttcccttactttgactacgtcggggaccagggaacttcgacggtccaccgtctccgcgacgccctaccaccgaacgggcccacgtcccgg

SEQ ID NO: 359304 - DNA, 619 bp, Homo sapiens
  misc_feature: GZ8MTXP02J25GV.17.33.C11.1.454.CMB.2.raw
  modified_base (294)..(294): a, c, t, g, unknown or other
  misc_feature (294)..(294): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacagcaccaggcactcatttanagtacaaacaacaacactctcggaccctgcccgattctacaggcctcccccgtccgttggggcaaagctcgccctgacactgtcgtggtcgtgcagcccgtggacggacgacgggcttacggactacttactacgcctactcttacgtttggtggtgtcgtggtgtcgtacgttcggggacgggtaacggggacccgaaagtcgtacggtacccggtacgtttaacggtacctaacgtccccgtaaacggccctaccggtccccccgttaaccgggtcctaaccggtccctttccggttcccccggtccctaaccctttccccgg

SEQ ID NO: 359305 - DNA, 571 bp, Homo sapiens
  misc_feature: GZ8MTXP02F6DQG.17.33.C11.1.454.CMB.2.raw
  modified_base (296)..(296): a, c, t, g, unknown or other
  misc_feature (296)..(296): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtaacaaacaacaaaacactcctacggacccctgacccgtattcctcacggtcctcccccctccgttcggggacaaacgctcgccctgacactgtctggtgtgcagctagagacgagctgactatactgcctactctacttggtgtgtctgtgctagttcgggcggtacggggaccaaagcgtacgtaccgttactaaggtcctaacggcccgaacggccttccggcccccgtcggtcctacttccgtccgttcccctaccctcccttaacccg

SEQ ID NO: 359306 - DNA, 552 bp, Homo sapiens
  misc_feature: GZ8MTXP02G2FO3.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaacggccctggagtggcttgcgctcatttatgggatgagagtaagcactacagtccgtctctgaaagaacaggctccaccatcaaccaaggaccacctccaacaaaaccaggtcgtaccttacaaatcgaaccaaatatcggaccctgtcggacacacgccacatattaactgttacacgtctctagtgggttacggggtagttattacgtccctattgactacgtggggaccagggactcgtcggtcaccgtctccgcacgcctaccaccgaacggcccagtcccgg

SEQ ID NO: 359307 - DNA, 605 bp, Homo sapiens
  misc_feature: GZ8MTXP02GZFES.17.33.C11.1.454.CMB.2.raw
  modified_base (426)..(426): a, c, t, g, unknown or other
  misc_feature (426)..(426): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgcacgccccgaggaaacggccctggagtggcttgcgctctatttagtgggatgagagtaagcactacagtccgtctctagaaagaacaggctccaccatcaccaagaccacctccaaccaaaccaggtacgtccttaacaatacgaaccaatagtcgaccttgacgacacagaccanatattactgttcacgtctcgttagtggggttacggggatttacgttacgttcccttagtttagaccgtacggttacgggggaccctaaggggtaaccttcgtcgggttacccctaccggttccacccgggcaccggaccccttacccgaaccgaaccggggtcccaacgtttccccggg

SEQ ID NO: 359308 - DNA, 523 bp, Homo sapiens
  misc_feature: GZ8MTXP02IWHNP.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttatgggatgagagtaagcactacagtccgtctctgaagaacaggctccaccatcaccaagacacctccacaaaccagtgtccttacaatgaccaatatcggaccctgtgacacagcccacatattactgttcacgtctctatggttcggggattattagtccctatttgactactggggccagggaactctggtccaccgtctccgcacgcctccaccaacggccagtcccgg

SEQ ID NO: 359309 - DNA, 531 bp, Homo sapiens
  misc_feature: GZ8MTXP02JBI79.17.33.C11.1.454.CMB.2.raw
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaagccctggagtggcttgcgctcatttattgggatgagagtaagcactacagtccgtctctgaagacaggctccaccatcaccagaccacctccacaaaccagtgtcctanatgaccatancgacctgtgacacagccacatattactgttcacgtctctagtggttcggggatttattagtcccttatttgacttacgtcggggccaggggacctcgtcggtccaccgtctaccgcacgccctccaccgaacggcccagttccccgg

SEQ ID NO: 359310 - DNA, 563 bp, Homo sapiens
  misc_feature: GZ8MTXP02I02AR.17.33.C11.1.454.CMB.2.raw
  modified_base (316)..(316): a, c, t, g, unknown or other
  misc_feature (316)..(316): n is a, c, g, or t
  modified_base (440)..(440): a, c, t, g, unknown or other
  misc_feature (440)..(440): n is a, c, g, or t
  modified_base (540)..(540): a, c, t, g, unknown or other
  misc_feature (540)..(540): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatcgtcacgccccaggaagcctggagtgctgcgctcatttatgggatggagagtaagcactacagtccgtntctagaaagacaggctccaccatacaccaaggaccaccctccaacaaaccgaggtcgtaccttaacaatcgaaaccaatacgtcggaccctgcgacacacgccaacatacttactgttacactntactagttcgggttacggggtatttattacggtcccttagtttcgaacttacggtcggggccctaggggtaacctcgtcgtccaccgtctccgcacgccnccaccgacggaccgacgttcccg

SEQ ID NO: 359311 - DNA, 618 bp, Homo sapiens
  misc_feature: GZ8MTXP02F922K.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaaacggccctggagtggcttgcgctctatttatgggatgagagtaagcactacagtccgtctcgtagaaagaacaggctaccaccactacaaccaaggaccacctccaaccaaaaccacggtacggtaccctttaacgaaatacgaaacctaaatactacgggaaccctggtacgacacgacgacccaacatattactgttcacgtctacttagtgggttacgggtagtttaacttacgttcccttacgtttagtacctacggttacgggggaccaaggggtaaccttcgtcggtaccgtaccggtcctccgaacgacgtccctacccgaaccgaacgggccctacgtttccccgg

SEQ ID NO: 359312 - DNA, 566 bp, Homo sapiens
  misc_feature: GZ8MTXP02IL6F1.17.33.C11.1.454.CMB.2.raw
  modified_base (295)..(295): a, c, t, g, unknown or other
  misc_feature (295)..(295): n is a, c, g, or t
  modified_base (449)..(449): a, c, t, g, unknown or other
  misc_feature (449)..(449): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggttccagcagaaacctggacaagccaccaggcactcatttanagtaacaaacaacaaaacactacctggaaccccctgacccgattcctcaggcctcccccgtccgttgggggacaaagctcgccctgaccactcgtctggtgtgcagcctggaggacgaggctgacttatactgcctactcttacttggtcggtncgtgtgcttagttcgggcggtacgggacaagtcgtacgtaccgtacttaagtcgacgcccaacggtcacccgtccccgtcggtcctaccgttctccgttccccaccctcccttcccg

SEQ ID NO: 359313 - DNA, 518 bp, Homo sapiens
  misc_feature: GZ8MTXP02GLB3S.17.33.C11.1.454.CMB.2.raw
  modified_base (436)..(436): a, c, t, g, unknown or other
  misc_feature (436)..(436): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtacaaacaacaaacactcctcggacccctgcccgattctcaggctccccctcctggggcaaagctcgccctgacactgtctggtgtgcagcctgagacgaggctgactattactgcctactctactttggtgtgctgtnctatcggcggaggaccagctgaccgtctaagtcacgcccaacgctcgccccctcggtcactctcgtccccgccctcctcccg

SEQ ID NO: 359314 - DNA, 555 bp, Homo sapiens
  misc_feature: GZ8MTXP02JCWCZ.17.33.C11.1.454.CMB.2.raw
  modified_base (314)..(314): a, c, t, g, unknown or other
  misc_feature (314)..(314): n is a, c, g, or t
  modified_base (368)..(368): a, c, t, g, unknown or other
  misc_feature (368)..(368): n is a, c, g, or t
  modified_base (391)..(391): a, c, t, g, unknown or other
  misc_feature (391)..(391): n is a, c, g, or t
  modified_base (524)..(524): a, c, t, g, unknown or other
  misc_feature (524)..(524): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaaaggccctggagtggcttgcgctcatttattgggatgagagtaagcactanagtccgtctctagaagaacaggctccaccatcaccaaggacacctccacaaacnggtcgtccttacaatgaaccaanatgaccctgtggacacagccacatattactgttcacgtctacttagtggttcggggtattagttacgttcccttagtttcgacttaacgtgggggacccaggggtaacctcgtacggtcctaccgtctcccgnacgccctccaccgaacggccccagttcccgg

SEQ ID NO: 359315 - DNA, 573 bp, Homo sapiens
  misc_feature: GZ8MTXP02HBLEV.17.33.C11.1.454.CMB.2.raw
  modified_base (374)..(374): a, c, t, g, unknown or other
  misc_feature (374)..(374): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaagccctggagtggctgcgctcatttatgggatgagagtaagcactacagtccgtctctgaaagacaggctccaccatcaccaagacacctccaacaaacaggtcgtacctanaatcgaaccaatactcggacctggtacgacacacgccaacatacgttactgttccacgtctctagtggttacgggtagttacttacgtcccttacgtttgacttacggttcggggacctaggggaacttccgtacgggtcctacccggtctcccggcgtacgacccgtacccacccgaacgggtccccacgttccccgg

SEQ ID NO: 359316 - DNA, 633 bp, Homo sapiens
  misc_feature: GZ8MTXP02JZA12.17.33.C11.1.454.CMB.2.raw
  modified_base (185)..(185): a, c, t, g, unknown or other
  misc_feature (185)..(185): n is a, c, g, or t
  modified_base (204)..(204): a, c, t, g, unknown or other
  misc_feature (204)..(204): n is a, c, g, or t
  modified_base (334)..(334): a, c, t, g, unknown or other
  misc_feature (334)..(334): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctnacgctgacctgcaccttcnctggcttctcactcagaacgagtggaatgggagtgggctggatccgtcacgccccaggaacgcctggagtggcttgcgctcatttagtgggatgatagtaagcactacacgtcgtctctagaaagaacgnggctccaccataccaaccgaaggacccaccctacccaaaccaaaaccgtacgggtacggttaccttaacgaaactacgaaaccctaaatacgtcgggaccctggtacgacacacgaccatattaacttacgtcgttaccacgtctacgttagttggggttcgggtaagtttaactttacggtacccttacgttttacgaacgttacggtcgggggacctacggggtaaccttcggtcggtacctaccgttccgtccgcgaccgtccctaccgaccggtaacggtccccagtttccccgg

SEQ ID NO: 359317 - DNA, 557 bp, Homo sapiens
  misc_feature: GZ8MTXP02HXOAO.17.33.C11.1.454.CMB.2.raw
  modified_base (421)..(421): a, c, t, g, unknown or other
  misc_feature (421)..(421): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactataccaaactggttccagcagaaactggaacagcaccaggcactcatttatagtacaaacaacaaacactcctacggacccctgcccgattctacaggtcctccccctccgttacgggggacaaagctcgccctgacactcgtctgtgtgcagcctgaggacgaggctagactatacngactactctacgtttggtggttgctgtgctagttcggtcggacgggaccaagcgttgaccgttcgttaagtcgagacccgacggtctccgcccccgtaacggtctactccgtccgttccctaccccttcctacccg

SEQ ID NO: 359318 - DNA, 545 bp, Homo sapiens
  misc_feature: GZ8MTXP02IZT27.17.33.C11.1.454.CMB.2.raw
  modified_base (282)..(282): a, c, t, g, unknown or other
  misc_feature (282)..(282): n is a, c, g, or t
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (348)..(348): a, c, t, g, unknown or other
  misc_feature (348)..(348): n is a, c, g, or t
  modified_base (358)..(358): a, c, t, g, unknown or other
  misc_feature (358)..(358): n is a, c, g, or t
  modified_base (508)..(508): a, c, t, g, unknown or other
  misc_feature (508)..(508): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgcacgcccaggaagcctggagtggctgcgctnattatgggatgangtaacncactacngtcgtctctagaagacngcaccacacacacacgaccaccnccaacaacgngtacgtactaacatcaacaatacgtacgacctgacgacacacgaccaatattacgttactgtcacgtctcgtagttacgggtacggtatttacgttacgttccttagttcgacgtacggtcggacgaggtactcgtcgtccgtaccgtcnccgcgcgaccgtaccgaccgaccggaccgtacgtccg

SEQ ID NO: 359319 - DNA, 602 bp, Homo sapiens
  misc_feature: GZ8MTXP02HXW67.17.33.C11.1.454.CMB.2.raw
  modified_base (300)..(300): a, c, t, g, unknown or other
  misc_feature (300)..(300): n is a, c, g, or t
tcagcgtagactagcacgaccggtgctcgatttagagtgagctcgttgggtttgggggcgccaggggtcccttccaatatcagcaccatggcctggactcctctctttctgttccttctcacttgctgcccagggtccaattctcagactgtggtgactcaggagccctcactgactgtcgtccccaggagggacagtcactctcacctgtgcttccaacactggagcagtcaccagtgtcttactatacctaaactggttaccagcagaaacctggacaagcaccaggcactcatttanagtacaaacaacaaacactcctacggacccctgacccgtatctcgagcctcccctccggtggggacaagctcgcctcgactactgtccgttgggtcgtgacgacgccgtagggacggacggagcgtagacttagttacgtcgtaccttactactttacggtttgggtggttcgtagttggtacgtcgttaggtccggggacgggtacggaaccgagtcgtacggtaccgttacgttagtccacggaccacggtccgtccgcccgtcggtctactccgtccttacccctccttcccgttaccg

SEQ ID NO: 359320 - DNA, 587 bp, Homo sapiens
  misc_feature: GZ8MTXP02HYXW8.17.33.C11.1.454.CMB.2.raw
  modified_base (385)..(385): a, c, t, g, unknown or other
  misc_feature (385)..(385): n is a, c, g, or t
  modified_base (444)..(444): a, c, t, g, unknown or other
  misc_feature (444)..(444): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaggccctggagtggcttgcgctcatttatgggatgagagtaagcactacagtccgtctctagaagaacaggctccaccatcaaccaaggaccacctccaacaaaccaggtcgtacccttaanaaactcgaacccaaagtactacgggacccctggtacggacacagcccaatataattacngttacacgtctctagtggttacgggtatttagttacgtcccttatttgaaccgttacgtcgggggacctaggggtaaccttcgtacggtaccacccggtctccgcgtacgccctaccaaccgaacgggccctacgttccccgg

SEQ ID NO: 359321 - DNA, 542 bp, Homo sapiens
  misc_feature: GZ8MTXP02GGLK0.17.33.C11.1.454.CMB.2.raw
  modified_base (489)..(489): a, c, t, g, unknown or other
  misc_feature (489)..(489): n is a, c, g, or t
tcagcgtagactagcacgaccggtgctcgatttagagtgagctcgttgggtttgggggactcctgtgccccaccatggacacactttgctccacgctcctgctgctggccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttatgggatgagagtaagcactacagtccgtctctgaagaacaggctccaccatcaccaaggacacctccacaaaccaggtcgtccttacaatcgaccaatatcggaccctgtgacacagccacatattactgttcacgctctagttggtacggggtattattacgtcccttattgactacgtcggggccaggggtactntcggtacaccgtctccgctacgccctaccaccgtaacgggccccagttcccgg

SEQ ID NO: 359322 - DNA, 635 bp, Homo sapiens
  misc_feature: GZ8MTXP02I5TCU.17.33.C11.1.454.CMB.2.raw
  modified_base (297)..(297): a, c, t, g, unknown or other
  misc_feature (297)..(297): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtaacaaacaacaaaacactacctcggacccctgacccgattcctcaggcctccccctccgttggggacaaacgctacgccctgacactgtctggtgtgctacgccgtgacgggacgacgggctagactacttacgtcgtacctacttcgttacgtttgggtcggttgtccgtggttcgtcgttagttcgggacgggaacgggacccgtaaagccgttacggtaacccggttcgtttaaaacggtccgaaacggtaccccgaaacggtcccgtcccgtacccccgtccgggttcccaaccttccgttccggtttccccgtccccttccctttacccg

SEQ ID NO: 359323 - DNA, 520 bp, Homo sapiens
  misc_feature: GZ8MTXP02GBSVQ.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaaacactcctggacccctgcccgatctcagctcccctctggggcaaagctgccctgaccactgtctgtgtgcacgcctgaggacgaggctgactattacagcctactctactttggtggtgctgtgctagttcggcggaggtaccaagctgacgtcttaagtcacgcccagctcgccccgtggtccacgtctcgtcccaccttccttaccg

SEQ ID NO: 359324 - DNA, 712 bp, Homo sapiens
  misc_feature: GZ8MTXP02F1Z8E.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaaaggccctggagtggcttgcgctctatttagtggatgagagtaagcactacagtccgtctctagaaagaacaggctaccaccatacaaccaagaccacctccaacaaaccaggtacgtaccttaacaaatcgaaacctaaatacgtacggaaccccttggtaggaaccaccgaagaccccaaataacttatttaaacctcgtttaccaaaccggttccttaccgttaaggttacggggtttaccgggggtaattttaacgtttaccggtttacccccttaagttttacggaaccgttaaccggttacgggggacccgtaaacgggggtaaacccttccggttaacggggttccctaaaccccgggttccttacccccgggaactaacccggtcccccttaacccccgaacccggtaaaaccggggccccctaaacgtttccccccgggg

SEQ ID NO: 359325 - DNA, 612 bp, Homo sapiens
  misc_feature: GZ8MTXP02G6UX3.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggactccgtcacgcccccgaggaaacggccctggagtggcttgcgctctatttagtgggatgagagtaagcactacagtccgtctctagaaagaacaggcctacccaccataccaaccgaaacggaccaccctcccaaaccaaaaccgtagggtacgttacccttaacaaacgttacgaaaccctaaatacgtacggtacccctggtacggacaccgacgacccaatatattacctgttaccacgtctcgttaggttgggttacgggtatttacttacgtccttagttcgactacggtcggggacagggtacctcgtcggtccaccgtctccgcgacgccctacgaccgaccggcccacgttccccgg

SEQ ID NO: 359326 - DNA, 578 bp, Homo sapiens
  misc_feature: GZ8MTXP02G8B6C.17.33.C11.1.454.CMB.2.raw
  modified_base (420)..(420): a, c, t, g, unknown or other
  misc_feature (420)..(420): n is a, c, g, or t
  modified_base (441)..(441): a, c, t, g, unknown or other
  misc_feature (441)..(441): n is a, c, g, or t
  modified_base (452)..(452): a, c, t, g, unknown or other
  misc_feature (452)..(452): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtcaccagtgcttactatccaaactggtccagcagaacctggacaagcacccaggcactcatttatagtaacaaacaaacaaaacactacctcggacccctgacccgattcctcacggcctccccctcgttggggacaaagctcgccctgacactgtctggtgtgcagcctgaggacgagctgactatacncgtacctactctacgtttggnggttgctggtntcgttagttcgggacgggacgggaccaagcgtacggtaccgttacttaaagtccgagaccccgaacgggcctccggacccccgtcggtacctaccgtccgtccgttccccgtcccttccctacccg

SEQ ID NO: 359327 - DNA, 534 bp, Homo sapiens
  misc_feature: GZ8MTXP02G5GHW.17.33.C11.1.454.CMB.2.raw
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttatgggatgagagtaagcactacagtccgtctctgaaagaacaggctccaccatcaccaaggaccacctccacaaacaggtgtccttanaatgaccaatangaccctgtgacacagccacatattactgttcacgtctctagtgggttacgggtagttagttagtcccttatttgactacgtcggggccagggaactcgtcggtcaccgtctccgcacgcctccaccaacggcccacgttcccgg

SEQ ID NO: 359328 - DNA, 601 bp, Homo sapiens
  misc_feature: GZ8MTXP02JKIKU.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaaacgccctggagtggcttgcgctctatttagttgggatgagagtaagcactacacgtccgtctctagaaagaacaggctcccaccatcaaccaaggaccaccctccaacaaaaccgaggtacgtaccttaacaaactcgaaaccctaaatacgtcggaccctggtacgacacacgaccacattacttactgttaccacgtcttctagttggttacgggtagttacttacgtcccttagtttagacttaacgtcggggaccagggtaaccttcgtacggtcctaccgtctcccggaacaccggaccctaccgaaccgaacgggcccctacgttccccgg

SEQ ID NO: 359329 - DNA, 623 bp, Homo sapiens
  misc_feature: GZ8MTXP02ICK3Y.17.33.C11.1.454.CMB.2.raw
  modified_base (583)..(583): a, c, t, g, unknown or other
  misc_feature (583)..(583): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccgaggaacggccctggagtggcttgcgctctatttagttgggatggagagtaagcactacagtccgtctctagaaagaacaggctccaccatcaacaacggaccacctccaaaccaaacaggtcgtaccttacgaatcgaaccctaatactcggaccctggtacgacacgaacgaccaactattaactttaacttcgtttaccaaccgtcttaccgttagttcggggtttacggggtagtttactttaacggttcccctttagtttgtacgttacggttcggggacccgtaggggtaaccttcggtcgggtaccaccggttcccnccgccgtacgccctaccgaaccggaccggtcctacgtccg

SEQ ID NO: 359330 - DNA, 526 bp, Homo sapiens
  misc_feature: GZ8MTXP02GQHN7.17.33.C11.1.454.CMB.2.raw
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
  modified_base (409)..(409): a, c, t, g, unknown or other
  misc_feature (409)..(409): n is a, c, g, or t
  modified_base (438)..(438): a, c, t, g, unknown or other
  misc_feature (438)..(438): n is a, c, g, or t
  modified_base (448)..(448): a, c, t, g, unknown or other
  misc_feature (448)..(448): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtacaaacaacaaacactcctggacccctgcccgattcncagctcccctccgtggggcaaagctgccctgcactgtctgtgtgcagcctgacggacgaggctgactattacngtacctactcttactttggtggtgctgtnctagttcggnggacgggacaagctgaccgtcttaaagtcagacccaagcctcgcccctcggtccactctcgttaccccaccctcctcc

SEQ ID NO: 359331 - DNA, 611 bp, Homo sapiens
  misc_feature: GZ8MTXP02I8HTR.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccgaggaaaggccctggagtggcttgcgctcatttagttgggatggagtagtaagcaactacagtccgtctctagaaagacaggctaccacatacacaagaccacctccaacaaaccagtacgtaccttaacaaatacgaaaccaaatatacggaccctagtacgacacacgaccaactataacttactcgtttacacgtctcgttagtgggttcggggtattacgttacgtacccttagtttcgacttacggtcggggtaccgaaggggtaacctcgttacggggtccaacccgttccgtacccgccgtacgccctacccgacccggtaaacggcccctaagtttcccccggg

SEQ ID NO: 359332 - DNA, 623 bp, Homo sapiens
  misc_feature: GZ8MTXP02JOCFA.17.33.C11.1.454.CMB.2.raw
  modified_base (148)..(148): a, c, t, g, unknown or other
  misc_feature (148)..(148): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggngtctggtcctacgctggtgaaaacccacacagacccctcacgctgacctgccaccttctctggcttctcactcagaacgagtggaatgggagtgggctggatccgtcacgccccaggaacggccctggagtggcttggcgctctatttatgggatgagagtaagcactacagtccgtactcgtagaaagacaggctaccgaccataccaaccgaacggaccaccctccaaaccaaaccgaggtacgtaccttaacaaactcgaaacccaattacgtacggaaccctggtacggaacacgacgacccaactattacttactcgttccgaacgtctacgttaggtgggttacggggtatttacgttacgttaccttagttcgtacgtacggtcggggacctaaggggtaacctcgtcggttccgaccgtccgtccggaacacgtacccaccgaaccgaccggccctacgttccccgg

SEQ ID NO: 359333 - DNA, 590 bp, Homo sapiens
  misc_feature: GZ8MTXP02HB407.17.33.C11.1.454.CMB.2.raw
  modified_base (321)..(321): a, c, t, g, unknown or other
  misc_feature (321)..(321): n is a, c, g, or t
  modified_base (457)..(457): a, c, t, g, unknown or other
  misc_feature (457)..(457): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaatgggagtgggctggatccgtcagccccaggaaagccctggagtggcttgcgctcatttatgggatgagagtaagcactacagtcccgtntctgaaagaacaggctccaccatcaaccaacggaccacctccaaccaaaccgacggttagtacccttaacaaatacgaaaccctaaatacgtcggtaaccctggtacggaacacgacgacccaactatactttacncgttacacgtctctagtggtacgggtagttattacgtccttagttgaccttaacgtcggggaccgtaggtaactcgtacggtcacccgtctcccggctacgccctccacccgaacgggcccaacgttccccgg

SEQ ID NO: 359334 - DNA, 623 bp, Homo sapiens
  misc_feature: GZ8MTXP02IZ85D.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaggccctggagtggcttgcgctcatttatggatgagagtaagcactacagtccgtctctagaaagaacaggctccaccatacaaccaaggaccaaccctccaacaaaacccgagggtacgtacccttaacgaaatacgaaccctaaatacgtcggaccctggtacggacacagccaacatattactgttcacgtctcgtagttgggttcggggtaagtttacttacgttcccttacgtttacgaaccgtacggttcgggggaccctaagggggtaaaccttcgtacggtcctacccggttccgtcccggaaccaacggtccctacccgaaccgaaacggggcccctaacgtttcccccgg

SEQ ID NO: 359335 - DNA, 631 bp, Homo sapiens
  misc_feature: GZ8MTXP02I7JAJ.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcacgccccgaggaacggccctggagtggcttgcgctctatttagtgggatgagagtaagcactacacgtccgtctctagaaagaacgaggtctaccaccataccaaccaacggaccaacctccaaacaaaccgtaggttaccgtaccttaacaaatacgaaacctaatacgtacggaccctggtacgaacacgacgaccaactattaacttacgtcgttaccacgtctacttaggttacgggttacgggtatttagttacgtcccttacgtttacgacttacggtcggggacgtaacgggtacgttcgttcggtaccgaccggttcctaccggaacctaccgccctacccgaaccgtaaccggccctacgtttccccgg

SEQ ID NO: 359336 - DNA, 595 bp, Homo sapiens
  misc_feature: GZ8MTXP02HMVF5.17.33.C11.1.454.CMB.2.raw
  modified_base (278)..(278): a, c, t, g, unknown or other
  misc_feature (278)..(278): n is a, c, g, or t
  modified_base (354)..(354): a, c, t, g, unknown or other
  misc_feature (354)..(354): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatcgcacgcccaggaagcctggagtgctgcgntcattagtggatgagagtaagcactacagtccgtctctagaagaacaggctccaccatccaaccaacggaccaccnccaaacaaaccgacggtacgtaccttaacaatacgaacctaatactacggaccctgtacggacacgagacccatagtacttactcgttcacgtctagtagtggttcgggtatttattacgtcccttagttgacgttacgtcggggacctaggggtaccttcggtacggttccaaccggttcccgacccgtaaccgaccgtacccgtacccgaacccggacccggtacccgtaccgttcccg

SEQ ID NO: 359337 - DNA, 561 bp, Homo sapiens
  misc_feature: GZ8MTXP02GUU6S.17.33.C11.1.454.CMB.2.raw
  modified_base (362)..(362): a, c, t, g, unknown or other
  misc_feature (362)..(362): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaagccctggagtggcttgcgctcatttatgggatgagagtaagcactacagtccgtctctgaagaacaggctcaccatcacaaggacacctccacaaaccnggtagtccttacaatgaccaatatggaccctgtgacacagccacatatactgttacacgtctctagtcgggttcggggaagtttacttacgtcccttactttgacgttaacgtgggggtcccaggggtaaccttcgtcgggtcctaacccggtctcccggaaccgccgtccctaccgaccgaccggccctacgtcccgg

SEQ ID NO: 359338 - DNA, 581 bp, Homo sapiens
  misc_feature: GZ8MTXP02H35NE.17.33.C11.1.454.CMB.2.raw
  modified_base (185)..(185): a, c, t, g, unknown or other
  misc_feature (185)..(185): n is a, c, g, or t
  modified_base (316)..(316): a, c, t, g, unknown or other
  misc_feature (316)..(316): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctnacgctgacctgcaccttctctggcttctcactcagaacgagtggaatgggagtgggctggactcgcagccccaggaaggcctggagtggcttgcgctcatttatgggatgagagtaagcactacagtcctntctagaagaacaggcctaccaccactcaaccaagaccaccctccaacaaacgagtcgtaccttacgaaattacgaacctaaatacgtcggaccctgtagggaacaacgacgaccaactattattactgttcacgtctacgtagttcgggttacggtagttagtttacgtccttactttggacttacggtcggggtaccgtaagggtacctcggtcggtaccaccgtcctccgcacgacctccgaaccgacggtccacgttcccgg

SEQ ID NO: 359339 - DNA, 558 bp, Homo sapiens
  misc_feature: GZ8MTXP02G13JA.17.33.C11.1.454.CMB.2.raw
  modified_base (297)..(297): a, c, t, g, unknown or other
  misc_feature (297)..(297): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtcaccagtgcttactataccaaactggttccagcagaaacctggacaagcaccaggcactcatttanagtaacaaaacaacaaaacactcctcgacccctcgaccgatctcacgctccccctcgtggggacaaagctcgcctgactactgtctggtgtgcagtcctaggaggacgagggctagtactattactcgcctacttcttactttggtgtgcttgtagcttagtcggacggacggaccaagcgtagaccgttattaacggtcacgaccgtacgcctccgccccgtcggtacaccgttctccgttccccacccttacttacccg

SEQ ID NO: 359340 - DNA, 551 bp, Homo sapiens
  misc_feature: GZ8MTXP02FRUX0.17.33.C11.1.454.CMB.2.raw
  modified_base (427)..(427): a, c, t, g, unknown or other
  misc_feature (427)..(427): n is a, c, g, or t
  modified_base (508)..(508): a, c, t, g, unknown or other
  misc_feature (508)..(508): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgcacgccccaggaagccctggagtggcttgcgctcatttatgggatgagagtaagcactacagtcccgtctctagaaagaacaggctccaccatcaccaagaccacctccaacaaacaggtcgtaccttacaatgaaccaatatcggaccctgtacgacacacgccatatattacgtnttacacgctctagtggttacggggatttatacgtcccttagttcgactacgtggggaccaggggtaacctcgtcggtaccnccgtcgtccgcacgccctaccgaccgaacggcccattccccgg

SEQ ID NO: 359341 - DNA, 557 bp, Homo sapiens
  misc_feature: GZ8MTXP02HB1RK.17.33.C11.1.454.CMB.2.raw
  modified_base (533)..(533): a, c, t, g, unknown or other
  misc_feature (533)..(533): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaacggccctggagtggcttgcgctcatttatgggatgagagtaagcactacagtccgtctctgaaagacaggctccaccatacaaccaaggaccacctccaacaaaccgaggtcgtacccttaacgaatacgaaccctaaatacgtcggaccctggtacgacacacgccaacatacttactgttacacgtctctagttgggttacgggtagttattacgtccttattcgactacgtcggggacagggactcgtcggtccacgtctcgcncgcctccgacacggccacgtcccg

SEQ ID NO: 359342 - DNA, 604 bp, Homo sapiens
  misc_feature: GZ8MTXP02I7W80.17.33.C11.1.454.CMB.2.raw
  modified_base (272)..(272): a, c, t, g, unknown or other
  misc_feature (272)..(272): n is a, c, g, or t
  modified_base (401)..(401): a, c, t, g, unknown or other
  misc_feature (401)..(401): n is a, c, g, or t
  modified_base (449)..(449): a, c, t, g, unknown or other
  misc_feature (449)..(449): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacacgaccctcacgctgacctgcaccttctctggcttctcactcagaacgagtggaatgggagtggctggactccgtcacgccccgaggaacgccgnggagtggctgcgctctagttagtgggatgagagtaagctactacagtccgtctcgtagaaagacaggcctaccaccactacaaccgaagaccaccctccaaaccaaaccgtaggtacgttacccttaanaacgtacgaaccctaaagttacgtacgtacccgtggtacgacaccgancccaactataacttactcgttaccacgtctactagggtttcgggttacgggtatttagtacgttcccttattgtaacgtcggtacggggactacgggactcgtcggtcctaccgtcgtccgcgacgtccctaccgaccgacggcctacgttcccg

SEQ ID NO: 359343 - DNA, 622 bp, Homo sapiens
  misc_feature: GZ8MTXP02GY5YI.17.33.C11.1.454.CMB.2.raw
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
  modified_base (362)..(362): a, c, t, g, unknown or other
  misc_feature (362)..(362): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactacggcacgccccaggaagcctggagtggctgcgctcatttagtggatgagagtaagcactacagtccgtctctgaacgaacnggcctaccaccanacaccaacggacctacccnccgaaccaaaccagggtcgtacccttaaacacgtacgaacaactacgtacgtacgtacgtacgacgacacgaccactactaacttacttacgtacgtacgtacttacgttacggttacgggttacgggttacgtttacgttacgttaccgttacgtttacgtacgtacggtacgggtacggtacggtacgtacgtacggtaccgtaccgtccgtccgccgtaccgacccgtacccgaccgaccggtaccgtaccgtcccg

SEQ ID NO: 359344 - DNA, 559 bp, Homo sapiens
  misc_feature: GZ8MTXP02F9PM6.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaaggccctggagtggcttgcgctcatttatgggatgagagtaagcactacagtcccgtctctagaagaacaggctccaccatacaccaaggaccacctccaacaaacaggtgtcccttaacaatcgaaccaaatatcggaaccctgtggaacacacgccaacattattactgttacacgtctctagtggttcgggtattattacgttcctagtttgaacttacgtcggggaccagggtaactcgtacggtccaccgtctccgcgacgccctacccacgaacggcccattccccgg

SEQ ID NO: 359345 - DNA, 551 bp, Homo sapiens
  misc_feature: GZ8MTXP02I1FBG.17.33.C11.1.454.CMB.2.raw
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
  modified_base (505)..(505): a, c, t, g, unknown or other
  misc_feature (505)..(505): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccggcacgccccaggaacgcctggagtggcttgcgctctattagttgggatgagagtaagcactacagtcctctctgaagacagctccacatcacacgacacctcacaacngtcgctanatnacatngactgngancancacatnttacagtcacgtntctagtggttcgggattatcgtaccttatttacgacttaacggtcggggaccgtaaaggggtaaccttcgtacgggttacctacccggttctcccggaanacccggtccctacccgaaccgaacggggtcccctacgtttccccgg

SEQ ID NO: 359346 - DNA, 631 bp, Homo sapiens
  misc_feature: GZ8MTXP02GQ42K.17.33.C11.1.454.CMB.2.raw
  modified_base (300)..(300): a, c, t, g, unknown or other
  misc_feature (300)..(300): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcaagaaacctggaacaagccaccgaggcactcatttanagtaacaaacaacaaacactcctcggacccctgcccgtattcctcacggtcctccccctcgttggggacaaacgctcgccctgacctacgtgtcgtggtcgtgcacgtcgtaggacggacggacgacgtagtaacttacgttacgtccgtaccttaacttcgtttaccggtttgggttcgggtcgttcgttcgtcgtacgttacggttccgggacggggtaacggaaccgaacggtcgaccggtacgttacgttacgacgtacggaccgaacgggtcctcccgtcccgtcggtcctaccgttcctcccgtacccctcccttccgttacccg

SEQ ID NO: 359347 - DNA, 606 bp, Homo sapiens
  misc_feature: GZ8MTXP02IZAE4.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaacggccctggagtggcttgcgctctatttagtgggatgagagtaagcactacagtccgtctctagaaagacaggctaccaccataccaaccaaggaccacctccaacaaaccgaggtacgtaccttaacaaatcgaaacctaaatacgtacggaccctggtacgaacacgacgcccaaactattacgttaactcgtttaccacgtcttacttagttgggttacggggtatttacgttacgtcccttagtttcgacttacggtcggggtaccgaggggtaacctcgtacggtccaccggtcctccgcacgccctaccgaaccgacgggccctacgtttccccgg

SEQ ID NO: 359348 - DNA, 526 bp, Homo sapiens
  misc_feature: GZ8MTXP02HHM1C.17.33.C11.1.454.CMB.2.raw
  modified_base (296)..(296): a, c, t, g, unknown or other
  misc_feature (296)..(296): n is a, c, g, or t
  modified_base (412)..(412): a, c, t, g, unknown or other
  misc_feature (412)..(412): n is a, c, g, or t
  modified_base (440)..(440): a, c, t, g, unknown or other
  misc_feature (440)..(440): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtacaaacaacaaaacactcctcgacccctgcccgatctcaggcctcccctccgttggggcaaagctgccctgacactgtctggtgtgcagcctgagacgaggctgactattacngcctatctacgtttggtggttgcttgtncgtagttcggcggacgggaccaagctgaccgtcgttaagtcacgaccacgctcgccccgtgtccactctcgtcccaccctcctccg

SEQ ID NO: 359349 - DNA, 724 bp, Homo sapiens
  misc_feature: GZ8MTXP02F6VY6.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagcccctcactgactgtcgtcccgagggaggacagtcactctccacctgtcgtccttaccaacacgtggacgcacgtaccaacctagtcgtaccttaactactaccctaaacgttcggttaccagacaaacgaaaccgtaggaaacaacgaccaacccggacgggaccactactaattttaataacgtaaaccaaaacaaaccaaaacctacctaccgtaccggaccccctcggaccccgtacttcctacgacggtcctccccccgttccggttcgggggacaaacgtctccgccctcgaccacgttcgtcgtggtgtcgcacgccgtaggacggacggaggcgtagtacgttattaccgtcgtacccttacttactttacggtttgggttcggtgtcgttgggtcgtacgtttacggttcggggacggggtaacggggacctaaggtcgtacggtaccgttacgttaaacggtacgaccgacccgtaacggtcccgttcccggcccccgttcggtaccctaccgttccgttcccgttacccctacccctccctttacccg

SEQ ID NO: 359350 - DNA, 674 bp, Homo sapiens
  misc_feature: GZ8MTXP02IJNI4.17.33.C11.1.454.CMB.2.raw
  modified_base (356)..(356): a, c, t, g, unknown or other
  misc_feature (356)..(356): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggactcggcacgccccaggaacgcctggagtggctgcgctctatttagttgggatggaagagtaagcactacacgttccgtctacgtagaaacgaacgaggctacccaccanaccaacgaaggaccaccaccaaactaaaccgacggtacgtacccttaacaaacttcgaaacctaatacgtacggaccctaggtacgaacacacgacccaaactattaacttaacgttcgtttaccaacggttccttagttaacggttcgggggttacggggttaatttaacgtttaccggttacccctttaacgtttgtaaccgttaacggttcggggaacccgttaggggaaccttcggttcgggtaccctacccggttccctaccggaaccgtaccgtacccgtacccgaacccgaccggtacccgtaccgtcccg

SEQ ID NO: 359351 - DNA, 558 bp, Homo sapiens
  misc_feature: GZ8MTXP02F7SNK.17.33.C11.1.454.CMB.2.raw
  modified_base (293)..(293): a, c, t, g, unknown or other
  misc_feature (293)..(293): n is a, c, g, or t
  modified_base (411)..(411): a, c, t, g, unknown or other
  misc_feature (411)..(411): n is a, c, g, or t
  modified_base (547)..(547): a, c, t, g, unknown or other
  misc_feature (547)..(547): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggtccagcaagaaacctgacaagcaccaggcactcatttanagtacaaaacaacaaacactcctacggacccctgacccgtattcctcacggtcctcccccctccgtaggggacaaagctacgccctgacactgtcctggtgtcgcagcctgaggacgngctagactatactcgacctactcttacttggtcgtgctgtagtcgtagtcgggacggaacggaccgaacgcgtacgaccgttactaaagtcacgaccgtacgcctcgacccccgtcggactactcgtccgtccccncctaccgttcc

SEQ ID NO: 359352 - DNA, 578 bp, Homo sapiens
  misc_feature: GZ8MTXP02GQKZV.17.33.C11.1.454.CMB.2.raw
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
  modified_base (326)..(326): a, c, t, g, unknown or other
  misc_feature (326)..(326): n is a, c, g, or t
  modified_base (343)..(343): a, c, t, g, unknown or other
  misc_feature (343)..(343): n is a, c, g, or t
  modified_base (358)..(358): a, c, t, g, unknown or other
  misc_feature (358)..(358): n is a, c, g, or t
  modified_base (381)..(381): a, c, t, g, unknown or other
  misc_feature (381)..(381): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaagtgggagtgggctgggactaccggcacgacccctaggaacgccctggagtggctgcgctntattagnggatgagagagcactacncgtctntanagaagacagcaccacanacgaacagaccaccncaacgaaacgtgtcgtacctaanatacacaactatacgacgtgagacacacacacatacttactactactacgtctacgtagtagggttacggttagttacgttacgttaccgttacgttacgtacgtacggtacgggtacggtacggtacgtacgtacgtaccgtaccgtccgtaccgccgaccgtacccgtacccgaccgaccggaccgtaccgtccg

SEQ ID NO: 359353 - DNA, 521 bp, Homo sapiens
  misc_feature: GZ8MTXP02F0137.17.33.C11.1.454.CMB.2.raw
  modified_base (300)..(300): a, c, t, g, unknown or other
  misc_feature (300)..(300): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtacaaacaacaaacactcctcggacccctgcccgatctcacgctccctcttggggcaaagctgccctgacactgtctggtgtgcagcctgaggacgaggctgactagtactgcctactcttactttggtgtgctgtgctattcggcggagggaccaagctgaccgtctaaagtcacgcccaaggcctcgccccctcggtccactctcgttccctacccc

SEQ ID NO: 359354 - DNA, 557 bp, Homo sapiens
  misc_feature: GZ8MTXP02GDJVE.17.33.C11.1.454.CMB.2.raw
  modified_base (433)..(433): a, c, t, g, unknown or other
  misc_feature (433)..(433): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggattctcactcagaacgagtggaatgggagtgggctggatccgtcacgccccaggaacgccctggagtggcttgcgctctatttatgggatgagagtaagcactacagtccgtctctagaaagacaggctaccaccatacaaccaaggaccacctccaacaaaccgaggtcgtaccttaacaatcgaacctaaatacgtcggaaccctggtacgacacacgcccanatacttactgttcacgtctctagtggtacggtattattacgtcctatttgacgttacgtcggggccaagggtactcgtcgtccaccgtctccgcacgccctaccaccgaacggccctagtcccg

SEQ ID NO: 359355 - DNA, 566 bp, Homo sapiens
  misc_feature: GZ8MTXP02H0YLM.17.33.C11.1.454.CMB.2.raw
  modified_base (438)..(438): a, c, t, g, unknown or other
  misc_feature (438)..(438): n is a, c, g, or t
  modified_base (522)..(522): a, c, t, g, unknown or other
  misc_feature (522)..(522): n is a, c, g, or t
  modified_base (535)..(535): a, c, t, g, unknown or other
  misc_feature (535)..(535): n is a, c, g, or t
  modified_base (540)..(540): a, c, t, g, unknown or other
  misc_feature (540)..(540): n is a, c, g, or t
  modified_base (559)..(559): a, c, t, g, unknown or other
  misc_feature (559)..(559): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccggtcacgccccgaaggaacggccctggagtggcttgcgctctatttagtgggatgagagtagcactacagtccgtctctagaaagacgacgctaccaccatacaaccgaagaccacctccaaacaaacgtaggtcgtaccttacaatacgaacctaaatatacggaccctggacgacacacgaccaanattactactcgttcacgtctactagtcgggttaggtattacttacgtccttacgtttgacttcggtcgggacctaggtactcgngtccacgtcgtcncgacnccctcaaccgtcggacccngttcccg

SEQ ID NO: 359356 - DNA, 582 bp, Homo sapiens
  misc_feature: GZ8MTXP02FSV0E.17.33.C11.1.454.CMB.2.raw
  modified_base (298)..(298): a, c, t, g, unknown or other
  misc_feature (298)..(298): n is a, c, g, or t
  modified_base (342)..(342): a, c, t, g, unknown or other
  misc_feature (342)..(342): n is a, c, g, or t
  modified_base (451)..(451): a, c, t, g, unknown or other
  misc_feature (451)..(451): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttaccagcaagaaacctggaacaagcaccaggcactcatttanagtaacaaacaacaaacactcctacggacccctgcccgattccncacggctccccctccgttggggacaaagctcgccctgacactgtctggtgtgcagcctgaggacgaggctagaccttatactgacctatctacgtttggtgtgtctgtntcgttagttcgggacggacgggaccaagcgtacgaccgttacttaaaggtcaacgacccgaaacgggtcctccggtcccccgtcggtccctacttcccgttccgtttcccctaaccccttcctttaccccg

SEQ ID NO: 359357 - DNA, 690 bp, Homo sapiens
  misc_feature: GZ8MTXP02IFO4O.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggactccgtcgacgccccgaaggaacgccctggagtggcttgcgctctattagtggatgagagtagcactacacgtccgtctctagaaagaacaggctacccaccactacaaccgaaacggaccaccctacccaaacaaaaccgacggtacgttacccttaacaaacttcgaaaccctaatacgtacggaccctaggtacgacacgacgacccaactattaacttacgttcgttaccacgtacttcgttacggttacgggtttaccggggtaagttttacgttaccgtttaccccgttaagtttacggtacgtaaaccgggtttcggggacccgttaagggggtaaaccctttcggtacggtaccccgtacccggttaccccgtacccgaaccgtacccgtaccccgtacccgaacccggtacccggtacccttaccggtccccgg

SEQ ID NO: 359358 - DNA, 607 bp, Homo sapiens
  misc_feature: GZ8MTXP02G68XE.17.33.C11.1.454.CMB.2.raw
  modified_base (297)..(297): a, c, t, g, unknown or other
  misc_feature (297)..(297): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttccaacactggagcagtcaccagtgcttactatccaaactggtccagcagaaacctggacagcaccgaggcacgtcatttanagtacaaataacaaacactcctggacccctgcccgatctcacgctcccctcgtggggcaagctgcctgaccatgtctggtgcgcgacgcctggaggacgaggctagactattaacgtgcctacttacgttacgtttcgggtggttgtctcggtagtcgttaagttcggggtacgggtacgggaccgaaacggtcgtacggtaccggttaccgttaaggtacgtaccggtcccgtaaacgggtcctaccggtcccccgtcgggtacctaaccggttcctaccggttccccctaaccccttcccgttccccg

SEQ ID NO: 359359 - DNA, 585 bp, Homo sapiens
  misc_feature: GZ8MTXP02JNNDS.17.33.C11.1.454.CMB.2.raw
  modified_base (175)..(175): a, c, t, g, unknown or other
  misc_feature (175)..(175): n is a, c, g, or t
  modified_base (185)..(185): a, c, t, g, unknown or other
  misc_feature (185)..(185): n is a, c, g, or t
  modified_base (290)..(290): a, c, t, g, unknown or other
  misc_feature (290)..(290): n is a, c, g, or t
  modified_base (413)..(413): a, c, t, g, unknown or other
  misc_feature (413)..(413): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccanacagaccctnacgctgacctgcaccttctctggcttctcactcagaacgagtggaatggggatgggctggatccggtcacgccccaggaaacggccctggagtggcttgcgctcntttatgggatgagagtaagcactacagtccgtctctgaagacaggctccaccatcaccaaggacacctccaacaaacaggtgtccttacatgaccaatatcggacctgtcgacacagcccaanattattactgttacacgtctcgttagttgggttacgggtatttacgttacgtaccctttagtttacgaacgtacggtacgggggaccgtaagggtaaccttcggttacggtaccgtacccgttctccgaacgtaccgtacccgtacccgaccgaccggacccgtacgtccgg

SEQ ID NO: 359360 - DNA, 631 bp, Homo sapiens
  misc_feature: GZ8MTXP02HWG0T.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtgggagtgggctggactccgtcacgccccgaggaacgccctggagtggcttgcgctctatttagtggatgagagtagcactacacgtcgtctcgagaaacgaacacgactacccaccactaccaaccgaacgaccaaccctccaaaccgaaaaccgtggttaccgtaccttaacgaacttacgaaacctaaagtacgtaccggacccttggacgaacacacgacccaatattatactgttacacgtcttcgtaggtgggtttaccgggtatttacttaccgtcccgttagttacgtacgtacggttacggggccctaaagggtaccttcggtcgtaccgtaccgtccgtccgaacgaccgttacccgacccgaaccgaccggtccctacgttcccccgg

SEQ ID NO: 359361 - DNA, 552 bp, Homo sapiens
  misc_feature: GZ8MTXP02J0UEI.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaagccctggagtggcttgcgctcatttattgggatgagagtaagcactacagtccgtctctgaaagaacaggctccaccatcaccaaggacacctccacaaaccagtggtccttacaatgacccaatatcggaccctgtgacacagaccacatattactgttcacgctctagttgggttacgggagtttacgttagttccctagtttcgacttacgttcgggggccaggggaactcgtcggtcacccggtctccggcacggccctcccaccgacgggcccacgttcccgg

SEQ ID NO: 359362 - DNA, 547 bp, Homo sapiens
  misc_feature: GZ8MTXP02GUPS5.17.33.C11.1.454.CMB.2.raw
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
tcagcgtagactagcacgaccggtgctcgatttagagtgagctcgttgggtttgggggactcctatgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaagccctggagtggctgcgctcatttatgggatgagagtaagcactacagtccgtctctagaaagaacaggctccacatcaaccaaggaccaacctccaacaaaaccgaggtacgtaccttaacaatgaaaccaatatcggacctgtgacacacgaccanatattacngttacacgctctaagtgggttacgggattacttagtcccttattgactacgtagggccagggtaactcgtggtccaccgtctaccgcacgccctacaccgaacggccctagtcccgg

SEQ ID NO: 359363 - DNA, 684 bp, Homo sapiens
  misc_feature: GZ8MTXP02GHGX5.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccgaggaaacggccctggagtggcttgcgctctatttatgggatgagagtaagcactacagtccgtctctagaaagacaggctccacatacaaccgaacgaccacctccaaaccaaaccgaggtacgtaccttaaacaatacgaacccaaatacgtacggaaccctggtacggaaccacgacgacccaactattaacttaacgttcgtttaccgaccgtacttaccgttaaggtttcggggttacccgggggttaattttaacgttaccggttaccctttaacgtttacgaaaccgtttacggtacgggggacccgtaaagggggtaaccttcggtacgggtacctaacccggttccgttcccgaaccgaaccgttccccgtaccccgaacccgaaaccgggggtccccctaacgtttcccccgggg

SEQ ID NO: 359364 - DNA, 652 bp, Homo sapiens
  misc_feature: GZ8MTXP02JLROW.17.33.C11.1.454.CMB.2.raw
  modified_base (296)..(296): a, c, t, g, unknown or other
  misc_feature (296)..(296): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccaacactggagcagtcaccagtgcttactataccaaactggttccagcagaacctggacagcaccgaggcactcatttanagtaacaaacaacaaacactcctacggacccctcgacccgtattcctcgacggtcctccccccgtccgttcggggacaaacgtcctcgccctgacctactcgtctgggtgtcgcacgccgtaggacggacggagcgtagacttattactcgacctacttacgttacgtttggtcggttgtcgttggtcgtcgttacggtcggggtacgggaacgggtaaccgtaacggtacgtacggtacccgttacgtttaaacggtaccgaacggacccgtaaacggtccgttcccggacccccgttcgggtaccctaaccgttcccgttcccgtttacccccacccccgtttcccttaccccg

SEQ ID NO: 359365 - DNA, 545 bp, Homo sapiens
  misc_feature: GZ8MTXP02JMHES.17.33.C11.1.454.CMB.2.raw
  modified_base (419)..(419): a, c, t, g, unknown or other
  misc_feature (419)..(419): n is a, c, g, or t
  modified_base (516)..(516): a, c, t, g, unknown or other
  misc_feature (516)..(516): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggatgggctggatccgtcagccccaggaaggccctggagtggcttgcgctcatttatgggatgagagtaagcatacagtccgtctctgaaagacaggctccacatcaaccaaggaccacctccaacaaacaggtcgtaccttaacgaatgaacccaatactcggaaccctgtagacacagacccanatattactgttcacgtctactagtgggttcgggtatttagtacgtcccttagtttgactacgtggggacccaggggaactcggtcgtcaccgttccnccgcacgccaccaccgacgaccgacgtcg

SEQ ID NO: 359366 - DNA, 639 bp, Homo sapiens
  misc_feature: GZ8MTXP02H4A2M.17.33.C11.1.454.CMB.2.raw
  modified_base (296)..(296): a, c, t, g, unknown or other
  misc_feature (296)..(296): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggaggacagtcactctcacctgtgcttccaacactggagcagtcaccagtgcttactataccaaactggtccagcagaaacctggacaagcaccaggcactcatttanagtacaaacaacaaaacactctacggaccctcgccgatcctcgacgcctccccgtcgtggggacaaagctcgccctgacactcgtcgtggtcgtcgcgtacgccgtaggacggacggaggcgtagtactagttactcgtccttactcgttacgtttggtggttcgtcgtggtcgtacgttacgttacggggacgggtaacgggaaccgtaaaggtccgtacggtaccgttaacgtttaaacggtaccgaaaccggtacccgaaacgggtcccttacccggacccccgttccgggtacctacccgttccgttccgttccccccggtccctttaccccgttcccg

SEQ ID NO: 359367 - DNA, 538 bp, Homo sapiens
  misc_feature: GZ8MTXP02H8JTP.17.33.C11.1.454.CMB.2.raw
  modified_base (380)..(380): a, c, t, g, unknown or other
  misc_feature (380)..(380): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccgtcagcccccaggaagccctggagtggcttgcgctcatttattgggatgagagtaagcactacagtccgtctctgaaagaacaggctccaccatcacaagacacctccaacaaacaggtgtcctacaatnaccaaatatggaccctgtgacacagccaacatattaactgttacacgtctctaatggttcgggggattatttagtcccttaactttgactacgtggggaccagggaactcgtaggtccaccgtctccgcacgcctccaaccacgggcccacgtcccgg

SEQ ID NO: 359368 - DNA, 628 bp, Homo sapiens
  misc_feature: GZ8MTXP02GEK5H.17.33.C11.1.454.CMB.2.raw
  modified_base (423)..(423): a, c, t, g, unknown or other
  misc_feature (423)..(423): n is a, c, g, or t
  modified_base (441)..(441): a, c, t, g, unknown or other
  misc_feature (441)..(441): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccgaggaacggccctggagtggcttgcgctctatttatgggatgagagtaagcactacagtccgtctctagaaagaacaggctccaccactcaccaaggaccacctccaacaaacaggtcgtaccttacaatgaaccaatatcgaccctgtacgacacagaccanatattactgtcacgtctnttagtgggttcggggtaagtttactttacggttcccttacgtttcgaacgttacggtacgggggtacccgtaaggggtaaaccgttccgttacgggttaccccgtacccgttcccgttcccggaaccgtaacgtcccccgtacccgaaccccggaaaccggggtccccctaacggtttccccccggg

SEQ ID NO: 359369 - DNA, 585 bp, Homo sapiens
  misc_feature: GZ8MTXP02IRFP9.17.33.C11.1.454.CMB.2.raw
  modified_base (432)..(432): a, c, t, g, unknown or other
  misc_feature (432)..(432): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtggggagtggggctggatccgtcacgccccaggaacggccctggagtggcttgcgctctatttagtgggatgagagtaagcactacagtccgtctctagaaagacaggctccaccatacaccaagaccacctccaaccaaaccgaggtcgtaccttaacaatcgaaccaatacgtacggaccctgagaacacagcccaanatacttactcttacacgtctcgtagttgggttacggggtatttacgttacgttacccttacgtttgacgtacggttcgggggacctaacggggacttcgtcggtccaccggtctaccgctacgcctacccacgaacggtcccacgttccccgg

SEQ ID NO: 359370 - DNA, 652 bp, Homo sapiens
  misc_feature: GZ8MTXP02G2JP6.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtgggagtgggctggactccgcacgccccaggaacgcctggagtggctgcgctctatttagtggatggagagtaagcactacagtccgtctacgtagaaagaacgacggctacccaccataccaaccaacggaccaccctaccaaaccaaaccgagggttaccgtaccttaacaaacttacgaaaccctaaatacgtacggacccgtggtaacggaaccacgaacgacccaaactaattaactttaacctcggtttaccaacggtcttaccgttaggttacggggttaccggggtatttaacgttacggttaccctttacgttttacgacgttaaccggtcgggggtacccaaggggtacctcgtacggtcctacccgtctccgctacgtcccaccgaacgaccggacccgtactccccgg

SEQ ID NO: 359371 - DNA, 617 bp, Homo sapiens
  misc_feature: GZ8MTXP02I1J3L.17.33.C11.1.454.CMB.2.raw
  modified_base (276)..(276): a, c, t, g, unknown or other
  misc_feature (276)..(276): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcaccttctctgcttctcactcagaacgagtggaagtgggagtgggctggactccgtcacgccccgaggaacggcccnggagtgcttgcgctctatttagtggatgagagtaagcactacagtccgtctctagaaagaacaggctccaccactacaaccaacggaccacctccaacaaaccgaggtacgtccttaacaatacgaaccaaatacgtcgtaaccctgtacggaacaccacgaccaactactaacttacttcgttacaccgtcttacgtacggttggggtttaccggggtagtttacgttaccggttacccttacgtttacgacgttacgggttcggggaccgagggtaactcgtcggtacctaccgtctccgcgacgtccctaccaaccgaccggccctacgttcccccgg

SEQ ID NO: 359372 - DNA, 536 bp, Homo sapiens
  misc_feature: GZ8MTXP02IBMW9.17.33.C11.1.454.CMB.2.raw
  modified_base (379)..(379): a, c, t, g, unknown or other
  misc_feature (379)..(379): n is a, c, g, or t
  modified_base (432)..(432): a, c, t, g, unknown or other
  misc_feature (432)..(432): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccgtcacgccccaggaagccctggagtggcttgcgctcattattgggatgagagtaagcactacagtccgtctctgaagacaggctccaccatcaaccaagaccacctacaacaaaccaggtgtaccttanatcgaaccatatcggaccctgtgacacagaccacatattactgttcacgtctntagtggttacgggtattacttacgtccttatttgactacgtgggccagggtactcgtacggtccaccgtctccgcacgcctccgaaccgacggcccagtcccgg

SEQ ID NO: 359373 - DNA, 526 bp, Homo sapiens
  misc_feature: GZ8MTXP02FIQ45.17.33.C11.1.454.CMB.2.raw
  modified_base (296)..(296): a, c, t, g, unknown or other
  misc_feature (296)..(296): n is a, c, g, or t
  modified_base (487)..(487): a, c, t, g, unknown or other
  misc_feature (487)..(487): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtacaaacaacaaacactcctggacccctgcccgattctcaggctccccctccttggggcaaagctcgccctgacactgtctgtgtgcagcctgaggacgaggctgactattactgcctactctactttggtggtgctgtgctattcggcggaggaccaaagctgaccgtcttaagtcagcccaaggtcncgccccctggtccactctcgttccccaccctcctacccg

SEQ ID NO: 359374 - DNA, 754 bp, Homo sapiens
  misc_feature: GZ8MTXP02J0ELT.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgccaccttctctggcttctcactcagaacgagtggaatgggagtgggctggactccgtcacgccccgaggaacgcctggagtggcttgcgctctatttagtgggatggagagtaagctactacgacgtcccgtctcgtagaaacgaacgaggcctacccaccactaccgaaacccgaaacggaacccaaccccgtacccaaacccgaaaaccccggtaggggttaccggttacccctttaaaacggaaacttacggaaaacccctaaagttaacggttacccgggtaaccccgttaggtaccgggaaacccaaccgaacgtacccccaaactaattaacgtttaaccttcggtttaccaaccggtcttacctttaggggttcgggggttaccggggttaagttttaacgttaccggtttccctttaacgttttcggaccgtttaaccggtcgggggtacccgtaaggggtaaccttcggttcggtcccgtaacccgttccgtacccggcaccggtaccctacccgaacccgtaaccgggtcccctacggttcccccgg

SEQ ID NO: 359375 - DNA, 579 bp, Homo sapiens
  misc_feature: GZ8MTXP02JFMG9.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatcgtcacgccccaggaaggccctggagtggcttgcgctcattatggatgagagtaagcactacagtccgtctctagaaagaacaggctccaccatcaaccaaggaccacctccaaacaaaccgagggtcgtaccttacaatcgaaccaatatcggaaccctgtcgacacacgccacatattactcgttcacgtctactagtgggttacggggtatttacgttacgttcccttagtttacgacgttaacggtcgggggaccaaggggtaacctcgtacggtccgacccgtcctaccgcacgtccctacccaccgaacgggccccagttccccgg

SEQ ID NO: 359376 - DNA, 602 bp, Homo sapiens
  misc_feature: GZ8MTXP02I70Y3.17.33.C11.1.454.CMB.2.raw
  modified_base (294)..(294): a, c, t, g, unknown or other
  misc_feature (294)..(294): n is a, c, g, or t
  modified_base (317)..(317): a, c, t, g, unknown or other
  misc_feature (317)..(317): n is a, c, g, or t
  modified_base (422)..(422): a, c, t, g, unknown or other
  misc_feature (422)..(422): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactggttccagcagaacctgacaagcaccaggcactcatttanagtaacaaacaacaaacactccncggacccctgcccgattctcacgcctaccccctcgtggggcaaacgctcgccctgaccacgtgtctggtgtgcacgcctgacgggacgaggctagactagttacncgtacctacttcgttacgtttgggtcggttcgcgttggtcgcgttacgttcggggcgggtaacgggacccaaaggcctcggtaaaccgttcgtttaaacgtccgtaacgaccgaaacggtccgttcccgcccccgttcggtccctacttcccgtcgttcccccacccttccctttacccg

SEQ ID NO: 359377 - DNA, 606 bp, Homo sapiens
  misc_feature: GZ8MTXP02H8WHM.17.33.C11.1.454.CMB.2.raw
tcagcgtagactagcacgaccggtgctcgatttagagtgagctcgttgggtttgggggcgccaggggtcccttccaatatcagcaccatggcctggacccctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttcccagcaagaaacctggaacaagccacccaggcactactatttataagtaacaaaacaacaaacactcctacggacccctgcccgtatctacacggcctcccgtccccgtggggaccaaagcctacgcccttgaccacgttgtccgttggtgtcgcgacgccgtggacggacgaggcagtacttattactcgaccttactctacgtttggtggtgtctgtgcttacgtcgggcggtacggaacctaagcgtacgtaccgtacgttacgtcgacgacccgaacggtcctcccgtccccgtcggtaacctccgtccgttccgtcccccgtccccttaccgttcccgtaccg

SEQ ID NO: 359378 - DNA, 567 bp, Homo sapiens
  misc_feature: GZ8MTXP02GNFS3.17.33.C11.1.454.CMB.2.raw
  modified_base (369)..(369): a, c, t, g, unknown or other
  misc_feature (369)..(369): n is a, c, g, or t
  modified_base (440)..(440): a, c, t, g, unknown or other
  misc_feature (440)..(440): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaaggccctggacgtggcttgcgctcatttatgggatgagagtaagcactacagtccgtctctgaagaacaggctccacatacaccaaggaccacctccaacaaaccnggtagtaccttaacatacgaaccaatatcggaaccctgtagacacagcacatattactgttacacgtcctntagtcgggttacgggtatttagttacgttcccttagtttacgactacgttcgggggacctaaggggtaacctcgtggtccaccgtctccgaagacgcctaccaccgtaacgggccctagttccccgg

SEQ ID NO: 359379 - DNA, 566 bp, Homo sapiens
  misc_feature: GZ8MTXP02GN4WL.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtccagatcaccttgaaggagtctggtcctacgctggtgaaacccacacagaccctcacgctgacctgcaccttctctggcttctcactcagaacgagtggaatgggagtgggctggatccgtcacgccccaggaacgccctggagtggctgcgctcatttatgggatgagagtaagcactacagtccgtctctgaaagacaggctccaccatcaccaagacacctccacaaaccaggtcgtaccttacaatcgaaccaaatactagaccctgtcggacaacacgaccaactatatttaactgtttcaacgtcgttactaagtgggtttacggggatttacgtttacgtcccttacttagactaacgtcggggcctaaggggaacttcgtgtaccaccgtcctccgcgacgccctacacccgtaaggacccattcccgg

SEQ ID NO: 359380 - DNA, 577 bp, Homo sapiens
  misc_feature: GZ8MTXP02ILNZB.17.33.C11.1.454.CMB.2.raw
  modified_base (225)..(225): a, c, t, g, unknown or other
  misc_feature (225)..(225): n is a, c, g, or t
  modified_base (315)..(315): a, c, t, g, unknown or other
  misc_feature (315)..(315): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtcccaggaggacagtcactctcacctgtgcttccaacactggancagtcaccagtgcttactatccaaactggtccagcagaacctggacagcaccaggcactcatttatagtaacaaacaacaaacactaccncggacccctgcccgtatctcacgcctcccccctcgtcggggacaaagctacgccctgacactgtctgtgtgcagcctgaggacgaggcgtagactattactgccttactcttactttggtgtgcgttgtgcgttagttcgggacggaggaaccgaagtcgtacgtaccgtacttaacggtacaacggtacccaacgggcctaccggacccccgtcggtacctaccgttccgttaccgttcccccaacccctttccctccccg

SEQ ID NO: 359381 - DNA, 648 bp, Homo sapiens
  misc_feature: GZ8MTXP02FOVB3.17.33.C11.1.454.CMB.2.raw
  modified_base (486)..(486): a, c, t, g, unknown or other
  misc_feature (486)..(486): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaatggggagtgggctggactccgtcacgccccaggaaacggccctggagtggcttgcgctctatttagtgggatgagagtaagcactacacgtccgtctactagaaacgaacgaaggtctacccaaccactacaacccgaaacggacccaaccctacccaaaccaaaacccgtacggggttacgttaccctttaaacaaacgtacgaaaccctaaattaaacgtcggaaccccttggacggaaccacacgacccanaacttattaactgttaccacgtccttataggttggttacggggtatttacgttacgttcccttatttacgacgttacggtacggggacctaaggggtaacttcgtacggtcctaccgtccgtccgaacacgccctaccgacgaaccgggccctagttccccg

SEQ ID NO: 359382 - DNA, 536 bp, Homo sapiens
  misc_feature: GZ8MTXP02GGGQ2.17.33.C11.1.454.CMB.2.raw
  modified_base (421)..(421): a, c, t, g, unknown or other
  misc_feature (421)..(421): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttatgggatgagagtaagcactacagtccgtctctgaagaacaggctccaccatcaccaagacactccacaaacagtgtccttacaatgaccaatatcggaccctgtggacacagccacatattactgttacncgtactctagtgggttcggggagtttattagttccctaatttgacttactcggggccagggaacctcgtcggtcaccgtctccgcacgcctccacccgaacgggcccattcccgg

SEQ ID NO: 359383 - DNA, 546 bp, Homo sapiens
  misc_feature: GZ8MTXP02IGJV2.17.33.C11.1.454.CMB.2.raw
  modified_base (385)..(385): a, c, t, g, unknown or other
  misc_feature (385)..(385): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgccaccttctctggcttctcactcagaacgagtggaatggggagtgggctggatccgtcagcccccaggaaaggccctggagtggcttgcgctcatttatgggatgagagtaagcactacagtccgtctctgaaagaacaggctccaccatcaacaagaccacctccaacaaaccaggtcgtccttaanaatgaaccaaatatcggaccctgtggacacagaccaacatattactgttacacgtctctagtggttcggggattattacgtccttatttgactacgtgggaccagggaactcgtacggtccacgtctccgcacgcctccaacgacgggacccagttcccgg

SEQ ID NO: 359384 - DNA, 570 bp, Homo sapiens
  misc_feature: GZ8MTXP02ILX2F.17.33.C11.1.454.CMB.2.raw
  modified_base (295)..(295): a, c, t, g, unknown or other
  misc_feature (295)..(295): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttanagtacaaacaacaaaacactacctggacccctgcccgattctcaggcctccccctccgttggggcaaagctcgccctgacactgtctggtgtgcagcctgagacgaggctagactattactcgcctactctacgtttggtcggttgctgtcgcttagttcgggcggtacggaccaagtctacgtaccgtacttaaagtcaacgacccgaacggcctccgcccccgttcggtcctaccgttccgtaccgttccccctaccccttaccctttccccg

SEQ ID NO: 359385 - DNA, 511 bp, Homo sapiens
  misc_feature: GZ8MTXP02GO00B.17.33.C11.1.454.CMB.2.raw
  modified_base (405)..(405): a, c, t, g, unknown or other
  misc_feature (405)..(405): n is a, c, g, or t
  modified_base (482)..(482): a, c, t, g, unknown or other
  misc_feature (482)..(482): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggcccctggagtggcttgcgctcatttattgggatgagagtaagcactacagtcccgtctctgaagacaggctccaccatcaccaggacactccacaacagtgtcctacatgaccatatgaccctgtgacacagccacanattactgttcacgctctatggttcgggagttattagtcctactttgactactggggccagggactctggtcaccgtntccgcagcctccaccacggcccatcccgg

SEQ ID NO: 359386 - DNA, 597 bp, Homo sapiens
  misc_feature: GZ8MTXP02JRP2B.17.33.C11.1.454.CMB.2.raw
  modified_base (442)..(442): a, c, t, g, unknown or other
  misc_feature (442)..(442): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatggggagtgggctggactccgcacgcccccaggaacggccctggagtggcttgcgctcatttatgggatgagagtaagcactacagtccgtctctagaaagacaggctaccacatccaaccaaggaccacctccaacaaaccgaggtcgtaccttacaatcgaaccaatagtacggtaccctgtacgacacacgaccacattacttactnttacacgtctcttagttgggttacgggtagtttacttacgtcccttactttcgacttacggtcggggaccgtaggggaacttcggtacggtacctacccgtcctccgccgtaccgtacccgtaccacccggaaccgggccccacgtttcccccgg

SEQ ID NO: 359387 - DNA, 576 bp, Homo sapiens
  misc_feature: GZ8MTXP02HRPDY.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggactccgtcacgccccgaggaacgcccgtggagtggcttgcgctctatttagtggatgagagtaagcactacacgtcgtctcgtagaagaacacggctccaccatccaaccgaagacccacctcccaacaaaccgtggtcgtaccttaacaaatcgaaccaaatacgtcggaccctggtacgacacacgaccaactatacgttactcgttcacgttctcttaggtggttcgggagtttattcgtccttagtttcgactcggtcgggaccagggtactcgttacgccgtaccgtccgtacgcacgccctacgaccgaacggccctcgtcccg

SEQ ID NO: 359388 - DNA, 598 bp, Homo sapiens
  misc_feature: GZ8MTXP02HT4CX.17.33.C11.1.454.CMB.2.raw
  modified_base (185)..(185): a, c, t, g, unknown or other
  misc_feature (185)..(185): n is a, c, g, or t
  modified_base (382)..(382): a, c, t, g, unknown or other
  misc_feature (382)..(382): n is a, c, g, or t
  modified_base (421)..(421): a, c, t, g, unknown or other
  misc_feature (421)..(421): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctnacgctgacctgcaccttctctggcttctcactcagaacgagtggaatgggagtgggctggatccgtcagccccaggaagccctggagtggcttgcgctcatttattgggatgagagtaaagcactacagtccgtctctagaaagaacaggctcaaccatcgaaccaagaccactccacaaaccaggtcgtacctaanaatacaacaaatagtcgacctgacgaacacacacctaanatattacgtgttacacgtcttacgtagttacgggttagggtatttaacgttacgttaccctttagttacgacgttaacggtacggggaccgtaaagggtaccttcgtacggtaccacccgttccgtaccgtaaccgacgtacccgtacccgaaccgaaccggacccgtaccgttccg

SEQ ID NO: 359389 - DNA, 582 bp, Homo sapiens
  misc_feature: GZ8MTXP02GHEG3.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgtcacgaccccaggaacgccctggagtggcttgcgctctattagtgggatgagagtaagcactacagtccgtctctagaagaacagctaccacactcaccaaggaccacctccaacaaaccgaggtacgtacctaacaatacgaaaccaatacgcggtaccctaggtacgaacacgagcccaatatacttactgttacacgtctactaggttcgggttacggtattacgttacgttaccttattacgacgttacggtcggggacccaaggggtacctcgtcgtcctaccgtctaccgcaacgccctaccgaccgacgggccctagttccccg

SEQ ID NO: 359390 - DNA, 650 bp, Homo sapiens
  misc_feature: GZ8MTXP02JSJRF.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtaacaaacaacaaaacactcctacggacccctgcccgtattcctcacggcctccccctccgttggggacaaagctcgccctgacactgtccgtggtgtgccgacgtccctacgacgggaccggaggcctacggtaaccttagttaaccgtcgtaccccttaacttaccgtttaccgttttgggttcggttgtccgttggtcgtcgttaggttccgggacggggtacggggaacccgtaaagtcgtacggtaacccgttacgttaaacggtccgaacgaccccgaaacggtcccgtaccggtcccccgtcggtccctaccgttcctaccgttccccctaccctcccttaccccg

SEQ ID NO: 359391 - DNA, 713 bp, Homo sapiens
  misc_feature: GZ8MTXP02JWOIN.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcacgcccccgaggaacggcccgtggagtggcttgcgctctatttagttgggatgagagtaagcactacacgtccgtctcgtagaaagaacgacggctacccaccataccgaaccaacggaccaccctacccaaaccgaaaacccgtacgggttacgtaccctttaacgaaatacgaaaccctaaagttactacgggaccctggtacggacaccgacgacccaactattaacttaacgtcgtttaccacggtcttacgttacggtttgggggttacggggttacgtttaacgtttaaccggtttcccttaacgttttacgtaaccgttacgggttacgggggacccgtaaggggtaaccgttcggttacggggtaccctacccggttccgttaccccggcctaacccggtccccgtaccccgaacccggaaaccgggggtccccctaacggtttcccccggg

SEQ ID NO: 359392 - DNA, 675 bp, Homo sapiens
  misc_feature: GZ8MTXP02IXANR.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtggggctggactaccggtcgacgaccccgaggaaacgccctggagtggcttgcgctctatttagtgggatgagagtaagcactacagtccgtctacgtagaaagacaggtcctaccacctactacaaccgaaacggaacccaaccctacccaaaccaaaacccgtacgggttaccggttaccttaaacaaacgttacgaaaccctaaagtacgtacggacccctaggtaccggacaaccgacgacccacaattactttactacgttacaacggttctacgttacgttgggtacggggttagtttagtttacgtacctttaacgttcgtaacgttacggtacgggtaccgtaggtaacgttcgtcggtaacccgtaccggttcctccggaaccgaccgtacccgtacccgaccggtaaccggtcccgtacgtttcccg

SEQ ID NO: 359393 - DNA, 599 bp, Homo sapiens
  misc_feature: GZ8MTXP02JL6QS.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccgaggaaggccctggagtggcttgcgctcatttatgggatgagagtagacactacacgtccgtctctagaaagacaggctccaccatcaaccaaggaccacctccaacaaaccgaggtacgtcctaacaatgaaccaagtacgtacgacccgtgtacggaacacgacgacccaactattaacttactgttaccacgtctctagttgggttacggggtatttacgttacgtcccttagtttcgacttacggtcggggacctaaggggtaccttcgtcggtaccgacccgttcgtacccggcaccgtccctaccgacccgaaccgggtccctacgtttccccg

SEQ ID NO: 359394 - DNA, 659 bp, Homo sapiens
  misc_feature: GZ8MTXP02GT0BS.17.33.C11.1.454.CMB.2.raw
  modified_base (293)..(293): a, c, t, g, unknown or other
  misc_feature (293)..(293): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagcctcactgactgtgtccccagggaggacagtcactctcacctgtgcttccaacactggagcagtcaccagtgcttactatccaaactggtccagcagaacctggacaagcacccaggcactcatttanagtacaaaacaacaaacactcctcggacccctgcccgtattcctcacggtcctacccccctccgttcgggggactaaaacggccttcggcccctgacactgtcctgatgtgcagcccgtggaacggacggaggtcgtcggtaacttaacgttactcgaccttaaccttcgttaccgttttgggttgggtgtcgttggtcgtcgttacgttcgggacgggtaacggggaacccgaacggcgtacggtaaccccgtttacgtttaaacgtaccgtaaccggaccccgaaaacgggtccctacccggtccccccgttccggtaccctacccgtcccgtttcccggttacccccgtccccctttcccccg

SEQ ID NO: 359395 - DNA, 739 bp, Homo sapiens
  misc_feature: GZ8MTXP02GXC0H.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgcaccttctctggcttctcactcagaacgagtggaatgggagtgggctggactccgtcacgccccgaggaaacggccctggagtggcttgcgctctatttagtgggatgagagtaagcactacagtccgtctcgtagaaacgacaggctacccaccactacaaccgaaacggaccaaccctaccgaaaccaaaaccgacggggttaccgttaacccttaacaaaacttacgaaaaccctaaagttaacgtacgggtaaaccccgtggtacgggaacccaacgaacgaccccaaactaacttaactttaccgttacgttaccgtaaaccgtcttacgttaaggttcgggggtttaccgggggtaagttttaacgtttaccgttaccccgtttaacgttttacgtaaaccgttaacggttcgggggacccgtaaacgggggttaaaccttccggttaacgggttcccgtaaccccggtccgtacccgccgtaaccggtccccctacccgaaccggaaaccgggtcccctaacggtttcccccgg

SEQ ID NO: 359396 - DNA, 703 bp, Homo sapiens
  misc_feature: GZ8MTXP02HQZ4U.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtcgaaacccacacagacccctcacgctgacctgcctaccttctctggcttctcactcagaacgagtggaagtgggagtgggctggatccgtcacgccccaaggaacgccctggagtggcttgcgctctatttagtgggatgagagtaagcactacgacgtccgtctacgtagaaacgaacaggcctaccccaaccactaccaaccaaaggaccccaacctacccaaacctaaaaccgtagggttaccgttacccttaacgaaactacgaaaccctaaatacgtaccggaacccgtggtacggaaccacgacgacccaactattacttacttcgtttccaaccggttcttacgttagggttacgggggtttaccggggtaaagtttttacgttaccggttacccctttaagtttacgaacgttaccgggtcgggggaacccgtaggggtaaccttcggtacggtacccgtacccgttccgtcccggaactaaccgccccgtacccgaacccggtaaccgggcccctacggtttcccccg

SEQ ID NO: 359397 - DNA, 561 bp, Homo sapiens
  misc_feature: GZ8MTXP02H4IAT.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtaacaaacaacaaaacactacctcggacccctgcccattctcacgctcccctcgtggggacaaagctgccctgactactgtctggtgtgcagccgtggacggacgaggctagtacttattactcgtctactcttacgtttggtggtgtctgtgcgttagtcgggacggacggaccagcgtacgtaccgtcttaacgtcacggacccaacggcctccgcccccgttcggcctaccgtccgtcgttccccgcccttacccgtcccg

SEQ ID NO: 359398 - DNA, 532 bp, Homo sapiens
  misc_feature: GZ8MTXP02FGJN3.17.33.C11.1.454.CMB.2.raw
  modified_base (341)..(341): a, c, t, g, unknown or other
  misc_feature (341)..(341): n is a, c, g, or t
  modified_base (512)..(512): a, c, t, g, unknown or other
  misc_feature (512)..(512): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccggtcacgccccaggaagccctggagtggctgcgctcatttatgggatgagagtaagcactacagtccgtctctgaagaacaggctccaccancaccaaggaccacctccaacaaaccaggtgtaccttacaatgaacccaaatatcggaccctgagacacagcccatatatactgttcacgctctatgtcgggtagttattagtcctacttgtactactacgggtcgacggaacgtctcggtcgaccgtcctccgcacgcccnccaccgacggccgacgtccg

SEQ ID NO: 359399 - DNA, 483 bp, Homo sapiens
  misc_feature: GZ8MTXP02GOZ0S.17.33.C11.1.454.CMB.2.raw
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (276)..(281): a, c, t, g, unknown or other
  misc_feature (276)..(281): n is a, c, g, or t
  modified_base (283)..(283): a, c, t, g, unknown or other
  misc_feature (283)..(283): n is a, c, g, or t
  modified_base (285)..(286): a, c, t, g, unknown or other
  misc_feature (285)..(286): n is a, c, g, or t
  modified_base (293)..(294): a, c, t, g, unknown or other
  misc_feature (293)..(294): n is a, c, g, or t
  modified_base (298)..(299): a, c, t, g, unknown or other
  misc_feature (298)..(299): n is a, c, g, or t
  modified_base (301)..(301): a, c, t, g, unknown or other
  misc_feature (301)..(301): n is a, c, g, or t
  modified_base (303)..(304): a, c, t, g, unknown or other
  misc_feature (303)..(304): n is a, c, g, or t
  modified_base (306)..(306): a, c, t, g, unknown or other
  misc_feature (306)..(306): n is a, c, g, or t
  modified_base (308)..(309): a, c, t, g, unknown or other
  misc_feature (308)..(309): n is a, c, g, or t
  modified_base (311)..(311): a, c, t, g, unknown or other
  misc_feature (311)..(311): n is a, c, g, or t
  modified_base (313)..(313): a, c, t, g, unknown or other
  misc_feature (313)..(313): n is a, c, g, or t
  modified_base (315)..(316): a, c, t, g, unknown or other
  misc_feature (315)..(316): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
  modified_base (343)..(343): a, c, t, g, unknown or other
  misc_feature (343)..(343): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (454)..(454): a, c, t, g, unknown or other
  misc_feature (454)..(454): n is a, c, g, or t
  modified_base (456)..(456): a, c, t, g, unknown or other
  misc_feature (456)..(456): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagcgggctggctaacggcagaccctaggaagcctgngngnnnnnntngnngagagannacanncncnnananncncncnncacanacacncacacagngtactanananacatancgacngagacacacacacatatactntcacnctacgtagtaggtacggtagttatacgtactacgtactacgtacgtacggacgacgacgtcgtcgtcgctcncncgacaccaccaccgacgaccgacgtcg

SEQ ID NO: 359400 - DNA, 563 bp, Homo sapiens
  misc_feature: GZ8MTXP02GA057.17.33.C11.1.454.CMB.2.raw
  modified_base (527)..(527): a, c, t, g, unknown or other
  misc_feature (527)..(527): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaaggccctggagtggcttgcgctcatttattgggatgagagtaagcactacagtccgtctctgaaagacaggctccaccatacaccaaggaccacctccaacaaaccagggtacgtaccttaacgaaactcgaacctaaatatcggaaccctggtacgacacagaccacatattacgtgttacacgctacttagtggttcgggagtttattacgtccctatttgacttacgtcggggaccagggtactcgtacggtccaccgtcnccgcacgcctaccaccgacgggtcccacgttcccgg

SEQ ID NO: 359401 - DNA, 530 bp, Homo sapiens
  misc_feature: GZ8MTXP02H97JZ.17.33.C11.1.454.CMB.2.raw
  modified_base (501)..(501): a, c, t, g, unknown or other
  misc_feature (501)..(501): n is a, c, g, or t
  modified_base (506)..(506): a, c, t, g, unknown or other
  misc_feature (506)..(506): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaagccctggagtggcttgcgctcatttatgggatgagagtaagcactacagtccgtctctgaaagaacaggctccaccatcaccaagacacctccaacaaacagtgtccttacaatcgaccaatatggaccctgtgacacagccacatattactgttcacgtctcgtagtgggttcgggaattagttacgtcccttacttgacgtacgtggggccaagggtactcgtcgtccaccgttcnccgcncgcctcacgacggcctacgtcccg

SEQ ID NO: 359402 - DNA, 647 bp, Homo sapiens
  misc_feature: GZ8MTXP02IJ4VV.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgccaccttctctggcttctcactcagaacgagtggaagtgggagtgggctggatccgtcacgccccgaggaacggcctggagtggctgcgctctatttagtgggatggagtagtaagcactacacgtccgtctactaggaaacgacgagctacccaaccactaccaaccgaaacggacccaaccctaccaaaccaaaacccgtgggttaccgttacccttaagaaacttacgaaacccaatacgtacgacccttggacgacacgacacccaatattacgttaactcttaccacgtcttcgttaggttgggttacgggtaatttactttacgtaccccttagttttacgacgtacggtacggggtacccgagggtaaccttcgtacggttccgaccgttcacccggaataccggacccctaccgaaccgaacgggtccccacgtttccccgg

SEQ ID NO: 359403 - DNA, 594 bp, Homo sapiens
  misc_feature: GZ8MTXP02ITY85.17.33.C11.1.454.CMB.2.raw
  modified_base (427)..(427): a, c, t, g, unknown or other
  misc_feature (427)..(427): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccgtcagcccccaggaaacggccctggagtggcttgcgctctatttattgggatggagagtaagcactacgacgttcccgtctctagaaagacaggctaccaccatcaaccaagaccacctccaacaaaccaggtcgtcctacaatgaccaatagtcgaccctgtcgacacacgccaanactattactgtacacgcttctagtgggttcgggtattagttacgttcccttagtttcgacgttacggtcggggaccgtaggggtaaaccttcggtacggttccgtaccgttccgttcccgcgaccgtccctacccgaacccgaacggggcccctaacgtttccccgg

SEQ ID NO: 359404 - DNA, 564 bp, Homo sapiens
  misc_feature: GZ8MTXP02HNG1W.17.33.C11.1.454.CMB.2.raw
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
  modified_base (386)..(386): a, c, t, g, unknown or other
  misc_feature (386)..(386): n is a, c, g, or t
  modified_base (515)..(515): a, c, t, g, unknown or other
  misc_feature (515)..(515): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctgggctaccggtcagccccaaggaagccctggagtggcttgcgctcatttattgggatgagagtaaagcactacagtccgtctctgaaagacaggctcccacatacaccaaggaccacctcaacaaaccgngtcgtactanancacaatgacgactgacgacacacacatacttattactcgtacacgtctgtacgttcgggtcggtagtttacgttacgttaccttacgttacgacgtacggtacgggaccgtaggtactcgtacggtccnccgtccgtccgaacgaccgaccgtaccgaccgaccgaccgtaccgtccg

SEQ ID NO: 359405 - DNA, 624 bp, Homo sapiens
  misc_feature: GZ8MTXP02HPF64.17.33.C11.1.454.CMB.2.raw
  modified_base (292)..(292): a, c, t, g, unknown or other
  misc_feature (292)..(292): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtcaccagtgcttactatccaaactggtccagcagaactgacaagcaccaggcactcatttanaagtaacaaacaaacaaacactacctcggacccctcgacccgtattcctccacggtcctccccccgtccgttcgggggacaaacggtctcgccctgacctacgtcgtcgtggtcgtgcgacgccgtaggaggacgcggctgacttattactcgtacctacttcttacgtttggtcgttgtctgttcgcgttacggttcgggacgggtacgggaaccaacggcgttacggtaccgttacgtttaacggtacacggtacccgaacggtcccgttcccggcccccgttcggtcctaccgttcccttacccgtttcccccaccctttccctacccg

SEQ ID NO: 359406 - DNA, 529 bp, Homo sapiens
  misc_feature: GZ8MTXP02JYXPK.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctccaccatcaccaaggacacctccacaaaccaggtgtccttacaaatgaacccaatatggaccctgtcgacacagccacatacttactgttcacgtctctagtggttcgggagtttatagtccttattgactacgtgggccagggactcgcggtcaccgtctccgcacgcctccaccgacggcccagtcccgg

SEQ ID NO: 359407 - DNA, 683 bp, Homo sapiens
  misc_feature: GZ8MTXP02FWPY9.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccgaggaaacggccctggagtggcttgcgctcatttagtgggatgagagtaagcactacagtccgtctctagaagaacaggctaccaccatcaccaaggaccacctccgaacaaaccgtaggtcgtaccttaacaatcgaaccaaagtactacgggacccttaggtcggaaccaacgacgaccctaactattactttaaaccttggttaccaaccggtcttacctaagttgggtttaccgggggtatttacgttaccggttcccttaactttcggtaacgttaacggttcgggggaccgtaacgggggtaaaaccttcggttacgggtaccctaaccccgggttcctaccccgggtaacaaaccccgggtccccttacccccgaaccccggaaaaccgggggccccctaacggtttcccccccggg

SEQ ID NO: 359408 - DNA, 685 bp, Homo sapiens
  misc_feature: GZ8MTXP02JUD1D.17.33.C11.1.454.CMB.2.raw
  modified_base (332)..(332): a, c, t, g, unknown or other
  misc_feature (332)..(332): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacacgaccctcacgctgacctgccaccttctctggcttctcactcagaacgagtggaagtggggagtgggctggatccgtcacgccccgaggaaacggccctggagtggcttgcgctctatttagtgggatgagtagtaagcactacagtccgtctntgaaagaacacggctacccaccatacaaccgaaggaccacctcccaaaccaaaccgacgggttacggtaccttaacaaacttacgaaaccctaaagttacgtacgggtaacccttggtaacgggaaccacgacgacccaactacttaactttaacctcgttacctaaccggtaccttaccgttacggttcgggtttacggggtacggtttaacgtttacggttaccctttaccgtttacgtacgttaccggtacgggggtaccgtaacgggtaaccgtcgttacggtccgtacccggtccttcccggtaaccacgtcccgtacccgaaccgaaccggacccgacgttccccgg

SEQ ID NO: 359409 - DNA, 576 bp, Homo sapiens
  misc_feature: GZ8MTXP02HXUJY.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcttacgctggtgaaacccacacagaccctcacgctgacctgcaccttctctggcttctcactcagaacgagtggaatgggagtgggctggatccgtcacgcccccaaggaacggccctggagtggcttgcgctcatttattgggatgagagtaagcactacagtccgtctctgaagaacaggctccacatcaaccaaggaccacctccaacaaaccaggtcgtaccttacaatcgaacccaatatacgggaccctggtcggaacacacgacccaacattattaccttgttccacgtctctagtgggttacggggtatttaacgttcgtacccttactttgacgttacgtcgggggaccctaggggaacctgtcggtccaccgtctccgcacgccctccaaccgtacgggccctagtcccgg

SEQ ID NO: 359410 - DNA, 507 bp, Homo sapiens
  misc_feature: GZ8MTXP02JERQR.17.33.C11.1.454.CMB.2.raw
  modified_base (423)..(423): a, c, t, g, unknown or other
  misc_feature (423)..(423): n is a, c, g, or t
  modified_base (460)..(460): a, c, t, g, unknown or other
  misc_feature (460)..(460): n is a, c, g, or t
tcagcgtagactagcacgaccggtgctcgatttagagtgagctcgttgggtttggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcagctccccctctggggcaaagctgccctgacactgtctgtgtgcagcctgaggacgaggctgactattactgcctactctactttggngtgctgtgctattcggcggaggaccaagctgaccgtntaagtcagcccaagctcgcccctggtcacgtctcgtcccacctctcc

SEQ ID NO: 359411 - DNA, 703 bp, Homo sapiens
  misc_feature: GZ8MTXP02FKNQI.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccggtcacgaccccgaggaaacgccctggagtggcttgcgctctatttagtgggatgagagtaagcactacagtccgtctcgtagaaagaacgacggctacccaccactacaaccgaaacggtaccaccctacccaaaccaaaacccggtagggttaccgttaacccttaacaaacttacgaaacccaaattacgttacggaaccccgtggtacggaccaaccgacgaccaactacttactttaacttgttaccacgtcttacgttaggttggggttacggggtattttacgttacggtttacccttaacgttttacgaaccgtttacggtacgggggtacccgtaaggggtaaaccgttccgttacgggtacccgtaacccgggttcccttacccggccaaccggccccttaccccgaaccggaaacccggggtcccctaacggtttcccccgg

SEQ ID NO: 359412 - DNA, 706 bp, Homo sapiens
  misc_feature: GZ8MTXP02HB61S.17.33.C11.1.454.CMB.2.raw
  modified_base (175)..(175): a, c, t, g, unknown or other
  misc_feature (175)..(175): n is a, c, g, or t
  modified_base (185)..(185): a, c, t, g, unknown or other
  misc_feature (185)..(185): n is a, c, g, or t
  modified_base (397)..(397): a, c, t, g, unknown or other
  misc_feature (397)..(397): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccanacagaccctnacgctgacctgcaccttctctggcttctcactcagaacgagtggaatgggagtgggctggatccgtcacgccccaggaacggccctggagtggcttgcgctctatttatggatgagagtaagcactacacgtccgtctctagaaagaacaggctaccaccatacaaccaaggaccaccctccaaaccaaaccgacggttacgtacccttaanaaacttacgaaacctaaagtacgtacgggtaccctaggtacggaaaccaccaacgtacccaaactaattaactttacctacggtttaccaacccggttcttaccgttaagggtttcggggtttaccgggggtaagttttaacttacgggttacccctttaacgttttacggaaaccttaccgggttaccgggggaccgtaaacgggggtaaaccttcgttacggggtaccctaacccggttccgttccccgaacgacccgtaccccgtacccgaaaacccgaaccggggtcccctaacgtttcccccgg

SEQ ID NO: 359413 - DNA, 589 bp, Homo sapiens
  misc_feature: GZ8MTXP02HNS5F.17.33.C11.1.454.CMB.2.raw
  modified_base (325)..(325): a, c, t, g, unknown or other
  misc_feature (325)..(325): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatggggagtggggctggatccgtcacgccccaggaagccctggagtggcttgcgctctatttagtgggatgagagtaagcactacagtcccgtntctagaagacagctccaccatcaaccagaccacctccaacaaaccaggttcgtaccttaacaactacgaacctaatactacggaccctgtacggaacacgacgacccacacttattaacttcgtttcaattcgtacttcgtaagttcggggtttacggggtatttacgtttacgttcccttatttgacctacggtcggggccagggtactcgtacgggcctacccgtctccgcaccgtccctaccgaccgacgggccctaccgg

SEQ ID NO: 359414 - DNA, 585 bp, Homo sapiens
  misc_feature: GZ8MTXP02I0J9N.17.33.C11.1.454.CMB.2.raw
  modified_base (221)..(221): a, c, t, g, unknown or other
  misc_feature (221)..(221): n is a, c, g, or t
  modified_base (294)..(294): a, c, t, g, unknown or other
  misc_feature (294)..(294): n is a, c, g, or t
  modified_base (363)..(363): a, c, t, g, unknown or other
  misc_feature (363)..(363): n is a, c, g, or t
  modified_base (377)..(377): a, c, t, g, unknown or other
  misc_feature (377)..(377): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacnctggagcagtcacagtgcttacataccaaactggtccagcagaaactggacaagcacccaggcactcatttanagtaacaaacaacaaacactcctcgacccctgcccattctcagctcccctcgtggggcaaagctcgccngacactgtctgtgngcagcctgaggagaggctagactattactgcctactcttacgtttggtggttgtcgttgtcgtcgtagttcgggcgggaacgggaccaaagcgtacggtaccgttacgttaaacgcgtacggacccgaacgggtaccctccggtacccccgtcgggtacccctaaccttcccggttcgttacccccgtaccccttcccgtttaacccg

SEQ ID NO: 359415 - DNA, 636 bp, Homo sapiens
  misc_feature: GZ8MTXP02FO9ZX.17.33.C11.1.454.CMB.2.raw
  modified_base (214)..(214): a, c, t, g, unknown or other
  misc_feature (214)..(214): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttcncactcaagaacgagtggaatggggagtgggctggactccgtcacgccccaggaacgccctggagtggctgcgctcatttagtgggatgagagtaagcactacagtcccgtctcgtagaaagacaggctaccaccactcaaccaagaccacctccaacaaacgaggtcgtaccttaacaatacgaaccaaatacgtacggacccttggacggaacaccgaagacccaactaacttactttaacttcgttaccaccgtcttaccgttaagttcggggtttaccgggggtaatttacgtttacgttccccttactttacgaaccttaacggtcgggggacccaaagggggtaaccttcgtcgggtaccacccggtcctccggcctacggccctaccgaaccgaacgggcccctacgttcccccgg

SEQ ID NO: 359416 - DNA, 529 bp, Homo sapiens
  misc_feature: GZ8MTXP02JQG8B.17.33.C11.1.454.CMB.2.raw
  modified_base (204)..(204): a, c, t, g, unknown or other
  misc_feature (204)..(204): n is a, c, g, or t
  modified_base (257)..(257): a, c, t, g, unknown or other
  misc_feature (257)..(257): n is a, c, g, or t
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
  modified_base (331)..(331): a, c, t, g, unknown or other
  misc_feature (331)..(331): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
  modified_base (497)..(497): a, c, t, g, unknown or other
  misc_feature (497)..(497): n is a, c, g, or t
tcagcgtagactagcacgaccggtgctcgatttagagtgagctcgttgggtttgggggactcctgtgccccacatggacacacttttgctccacgctcctgctgctgaccatcccttcatgggtctttgtcccagatcaccttgaaggagtctggtcctacgctggtgaaacccacacagaccctcacgctgacctgcaccttntctgcttctcactcagacgagtgaatgggagtgggctggatccgcagcccccngaaaggccctggagtggctgcgctcnttattgggatgagagtaagnactacagtccgtctctgagacaggctcnccatcaccaaggacacctccaacaaaccnggtgtcttnaatgaccatatgacctntgacacngccanatattactgttcacgctctatgggttcgggtagtttattagtcccctatttcggataacgtgggggtccaggggaactcgtcggttcaccgtctccgcncgccctccacctaaacgggccccagttcccgg

SEQ ID NO: 359417 - DNA, 561 bp, Homo sapiens
  misc_feature: GZ8MTXP02I1I1U.17.33.C11.1.454.CMB.2.raw
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
  modified_base (412)..(412): a, c, t, g, unknown or other
  misc_feature (412)..(412): n is a, c, g, or t
  modified_base (437)..(437): a, c, t, g, unknown or other
  misc_feature (437)..(437): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttanagtacaaacaacaaacactcctggacctctgccccgattcncaggcctccctcgttggggcaaagctcgccctgacactgtctggtgtgcagcctgaggacgaggctgactattacngcctactcttacgtttggtgttcgntgtgtcttagttcggacggtagggaaccaaggctacggacccgttacgttaacggtcacgacccgaaacggtcctccggcccccgtcggtcctaccgttccgtccgttccccgccctttccccg

SEQ ID NO: 359418 - DNA, 726 bp, Homo sapiens
  misc_feature: GZ8MTXP02FPDZQ.17.33.C11.1.454.CMB.2.raw
tcagcgtagactagcacgaccggtgctcgatttagagtgagctcgttggggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgccaccttctctggcttctcactcagaacgagtggaagtgggagtgggctggactccgtcacgccccgaggaacggccctggagtggctgcgtctctatttagtgggatggagagtaagctactacgtacgtcccgtctcgtagaaagaacgacggctacccaccactaccaaccgaaacgaccaccctaccaaacaaaccgtaggttccgtaccttaacaactacgaacctaaatacgtacgacccgttggtacgaaccacgacacctaaactacttaagtttaccgtacgttaccaacccgtcttacgttaaggtttcgggggttacggggttaaacgtttacgtttaccggttaccctttaacgtttacgtaaccgtttaacggggtccgggggtacccgtaaacgggggtaacccttccggttaccggggttaccctacccgttcccggttacccgaacccgtacccggtaccccctaccccgaacccggaaacccggggtccccctacgggtttaccccccgg

SEQ ID NO: 359419 - DNA, 525 bp, Homo sapiens
  misc_feature: GZ8MTXP02G6MEY.17.33.C11.1.454.CMB.2.raw
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
  modified_base (492)..(492): a, c, t, g, unknown or other
  misc_feature (492)..(492): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcattatgggatgagagtaagcactacagtccgtctctgaaagaacaggctccaccatcaccaagacacctcacaacagtgtcctanatnacaatatgacctgtgacacagccacatattactgttcacgctctagttaggtcgggattatagtccccttagtttgactacgtggggccagggactcgtacgtccgacctcgtaccngacgcctaccaccgaaacggcccaagttcccgg

SEQ ID NO: 359420 - DNA, 594 bp, Homo sapiens
  misc_feature: GZ8MTXP02JVKX5.17.33.C11.1.454.CMB.2.raw
  modified_base (438)..(438): a, c, t, g, unknown or other
  misc_feature (438)..(438): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaacggccctggagtggcttgcgctcatttatgggatgagagtaagcactacagtccgtctctgaaagaacaggctaccaccatacaccaaggaccacctccaacaaacaggtcgtaccttacaatcgaaacccaaatactcggaccctggtacggacaccagcccaatatattacngttcacgctctagttcgggttacggggtatttacgtacgttcccttagtttcgacgttacgtcgggggacctaggggaaacctcgttacgggtcctacccggtcctccgccacggtcccctacccaacccggaacggggcccctacgttccccggg

SEQ ID NO: 359421 - DNA, 523 bp, Homo sapiens
  misc_feature: GZ8MTXP02FET31.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggctgcgctcatttattgggatgagagtaagcactacagtccgtctctgaagaacaggctccaccatcaccaaggaccactccaacaaaaccaggtgtcttacaatgaccaatatggaccctgtgacacagaccacatattactgttcacgctctatggttcgggagttattagtccctattgactactggggccaggggaactctggtcaccgtctcgcagccctccaccaagggcccagtcccgg

SEQ ID NO: 359422 - DNA, 567 bp, Homo sapiens
  misc_feature: GZ8MTXP02JS7VX.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaacggccctggagtggcttgcgctcatttattgggatgagagtaagcactacagtccgtctctgaagaacaggctcccaccatcaccaaggaccacctccaaccaaaccaggtcgtaccttacaatcgaaccaatatcgaccctgtgacacacgccacagtacttactgttacacgtctctagttgggttacgggtagtttattacgtcccttagtttcgtacgttacgtcggggccaaggggtactcgtcggtccaccgtcgtccgcgacgcctcccgaccgtacgggaccctagtccccgg

SEQ ID NO: 359423 - DNA, 541 bp, Homo sapiens
  misc_feature: GZ8MTXP02HP5UN.17.33.C11.1.454.CMB.2.raw
  modified_base (226)..(226): a, c, t, g, unknown or other
  misc_feature (226)..(226): n is a, c, g, or t
  modified_base (295)..(295): a, c, t, g, unknown or other
  misc_feature (295)..(295): n is a, c, g, or t
  modified_base (317)..(317): a, c, t, g, unknown or other
  misc_feature (317)..(317): n is a, c, g, or t
  modified_base (332)..(332): a, c, t, g, unknown or other
  misc_feature (332)..(332): n is a, c, g, or t
  modified_base (379)..(379): a, c, t, g, unknown or other
  misc_feature (379)..(379): n is a, c, g, or t
  modified_base (411)..(411): a, c, t, g, unknown or other
  misc_feature (411)..(411): n is a, c, g, or t
  modified_base (476)..(476): a, c, t, g, unknown or other
  misc_feature (476)..(476): n is a, c, g, or t
  modified_base (528)..(528): a, c, t, g, unknown or other
  misc_feature (528)..(528): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtcccaggaggacagtcactctcacctgtgcttccaacactggacncagtcaccagtcgcttactatccaaactggttccagcacgaaactggacagcaccaggcactcatttanagtacaaacaacaaacactccncgacccctgccatcncacgcctccccgtcgtggggacaacgctcgcctgacactgtctggtncgcagtcctggacgacgagctagactattacncgtcctacttcttacgtttggtcggtgtctgtagcgttagtcggcggaggtacagctcggacctntacgctacgcccgagtcctccgtaccccgtcggtctaccgtctaccgtcccncccgttctacccg

SEQ ID NO: 359424 - DNA, 613 bp, Homo sapiens
  misc_feature: GZ8MTXP02ID590.17.33.C11.1.454.CMB.2.raw
  modified_base (388)..(388): a, c, t, g, unknown or other
  misc_feature (388)..(388): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactaccggtcacgccccaggaacgcctggagtggcttgcgctcatttagtgggatgagagtaagcactacagtccgtctctagaaagacaggctccaccatacacgaagaccacctccaacaaaccacggtgtacccttaaanatacaactaatcgtacgacctgacgacacacgacctaactattacttaccgtacgttaccacgttcttacgttagggttacggggttacgggttaatttacgttaccgttacccgtttaacgttacgtaccgtacgggtacggggaccgtaacgggtacttcggtcgtacccgtccgtccgaccgccgtacgtcccgtaccgaccggaccggtccctacgtcccg

SEQ ID NO: 359425 - DNA, 630 bp, Homo sapiens
  misc_feature: GZ8MTXP02H3S2F.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccgtcacgccccaggaacggccctggagtggcttgcgctcattatgggatgagagtaagcactacagtccgtctactagaagaacaggctaccacccataccaaccaaggaccaaccctccaaaccaaacccgtagggttacgttaccctttaacaaacttcgaaccctaaatacgtacgggtacccctggtacggaacaccgacgaccaacatacttacgtgttaccacgtctacgtagttcgggttacgggtagtttacgtttaacggtccctttaacgtttcgtaaccgttacggtcggggaccgtaaggggtacctcggtacggtcctaaccggtcctccgcacgccgtaccaaccgtaaccgggcctaacgtcccgg

SEQ ID NO: 359426 - DNA, 600 bp, Homo sapiens
  misc_feature: GZ8MTXP02HITVI.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaacggccctggagtggcttgcgctctatttagtgggatgagagtaagcactacagtccgtctctagaagacaggctcccaccatccaacaagaccacctccaacaaaccgtaggtacgtaccttaacaagtcgaaaccctaatacgtacggaccctggtacggaacacgacgccaactatactttactgttaccacgtcttacgtagttgggttacgggtatttagttacgttcccttagtttacgacgttacggtcggggaccctaggggtaacctcggtacggtaccaccgttctccgcgacgtccctccgaaccgacgggaccctacgttccccgg

SEQ ID NO: 359427 - DNA, 643 bp, Homo sapiens
  misc_feature: GZ8MTXP02G8Y9L.17.33.C11.1.454.CMB.2.raw
  modified_base (292)..(292): a, c, t, g, unknown or other
  misc_feature (292)..(292): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactggtccagcagaacctggacagcaccaggcactcattanagtaacaaacaacaaacactacctacggaccccctcgacccgtacttcctaccacggtcctccccccgtccgttcgggggaccaaaacggtcctcgccccgtgacctactcgtccgtgggtcgtcgccgacgccgtaggacggacggaggcgtagtacttacttactcgtaccttacttcgttacgtttgggtggttgtcgttggtgtccgttaggttccgggacgggacgggtaccaacggtcgtacgaccgttacgttaacgtaccgaccggacccgtaacggtcctaccgtcccccgtccggtaccctacccgttcgttcccggttccccgtcccccgttccttcccg

SEQ ID NO: 359428 - DNA, 532 bp, Homo sapiens
  misc_feature: GZ8MTXP02HYHAZ.17.33.C11.1.454.CMB.2.raw
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (496)..(496): a, c, t, g, unknown or other
  misc_feature (496)..(496): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggactccgtcacgcccccgaggaaacggccctggagtggcttgcgctctatttagttgggatgagagtaagcactacagtccgtctcagaaagacgaggctccacatcacagacacctcacaaacagtgtacctacatanacanangaccngcganacagcaacntatactgtcacgtctctagtcggttaggggtattagttctccttacttgactacgtcgggcctagggactcgtggaccaccggttccnccgcgacgtcccaccgaccgacggccctacgtcccg

SEQ ID NO: 359429 - DNA, 620 bp, Homo sapiens
  misc_feature: GZ8MTXP02G4KGD.17.33.C11.1.454.CMB.2.raw
  modified_base (295)..(295): a, c, t, g, unknown or other
  misc_feature (295)..(295): n is a, c, g, or t
  modified_base (340)..(340): a, c, t, g, unknown or other
  misc_feature (340)..(340): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttanagtaacaaacaacaaaacactcctacgacccctgacccgattccncacggtcctccccctccgttggggacaaacgctcgccctgactactgtctggtgtcgcagcctggacggacgaggctgactattacgtcgcctacttcttacgtttggtggtgcttgtcgcttagtcgggtacgggacgggtaccagtcgtacggtaccgttacgtttaacggtaccacggacccgtaaacggtcccgtacccggtccccccgttaacgggtaccctaccgttcccgttacccggtttacccccctacccccgttccctttaacccccgg

SEQ ID NO: 359430 - DNA, 743 bp, Homo sapiens
  misc_feature: GZ8MTXP02HJC6L.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctgcttctcactcagaacgagtggaagtggggagtgggctggatccgtcacgcccccgaggaacgccctggagtggcttgcgctctatttagtgggatgagagtaagcactacagtccgtctactagaaagaacgacggtctaccccaacccaataccaacccgaaaacggaccctaacccctacccaaaaccgaaaaacccgaggggtttaccggtaaccctttaaacgaaaacttacggaaaccctaaattaacgtaccggggtaaccccttagggttaccggaaaccaacgaaccggacccctaaacctaagtttaaacctttaccgttacgtttccgaaccggttcccttacgttaacgggtttcgggggtttaccgggggttagttttaaacgtttaccgttaccccgtttaactttcgtaaaccgtacgggtttcgggggaccgtaaggggtaacctcggttacgggtacctacccggtcctaccggccacgtcccctacccgaccgaaccggggccctaggtttcccccgg

SEQ ID NO: 359431 - DNA, 552 bp, Homo sapiens
  misc_feature: GZ8MTXP02J1OMY.17.33.C11.1.454.CMB.2.raw
  modified_base (320)..(320): a, c, t, g, unknown or other
  misc_feature (320)..(320): n is a, c, g, or t
  modified_base (367)..(367): a, c, t, g, unknown or other
  misc_feature (367)..(367): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtggctggatccgtcagccccaggaaaggccctggagtggcttgcgctcatttattgggatgagagtaagcactacagtccgtntctgaaagaacaggctccaccatcaaccaaggacacctccacaaacnggtgtccttacaatgaccaatatgaccctgtgacacagccacatattactgttcacgctctagtgggttcgggagtttattacgtcccttaatttgaaccgtacgttcgggggccagggggaaccttcgtcggtactaccgtctccggcacggccctaccacccgaacgggccccagttccccgg

SEQ ID NO: 359432 - DNA, 558 bp, Homo sapiens
  misc_feature: GZ8MTXP02F98O6.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccgaggaaaggccctggagtggcttgcgctctatttattgggatgagagtaagcactacagtccgtctctagaagaacaggctccaccatcaccaaggaccacctccaacaaaaccgaggtacgtccttaacaatcgaaccaatacgtcggaccctgtcgacacagccaacatattactgttcacgtctactagtggttacgggtagtttacttacgtcccttatttcgacttacgtcggggaccctagggactcgtgtcctaccgtctccgcacgcctaccacgacggcccagttcccg

SEQ ID NO: 359433 - DNA, 568 bp, Homo sapiens
  misc_feature: GZ8MTXP02ID0HB.17.33.C11.1.454.CMB.2.raw
  modified_base (389)..(389): a, c, t, g, unknown or other
  misc_feature (389)..(389): n is a, c, g, or t
  modified_base (404)..(404): a, c, t, g, unknown or other
  misc_feature (404)..(404): n is a, c, g, or t
  modified_base (428)..(428): a, c, t, g, unknown or other
  misc_feature (428)..(428): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaacggccctggagtggcttgcgctctatttagtgggatgagagtaagcactacagtccgtctctagaaagacaggctaccaccatcaaccaaggaccacctccaacaaaccaggtacgtaccttaanaatcgaaccaatacncggaccctggtgacacagcccaanatattactgttcacgtctactagttgggttacggggtatttagttacgttcccttagtttagacgttacgtcggggaccaaggggacttcgtcggtcaccgtctccgcacgtcctaccgaccgacggccctacgttcccg

SEQ ID NO: 359434 - DNA, 699 bp, Homo sapiens
  misc_feature: GZ8MTXP02H1W15.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtggggagtgggctggactccgtcacgcccccgaaggaacggccgtggagtggcttgcgctctatttagttgggatgagagtaagcactacgacgtccgtctctagaaagaacgacggctacccaccactaccaaccgaacggaccaaccctaccaaaccaaaaccgacggtacgtaccttaacgaaactacgaaaccctaaatacgtcggacccttaggacgaacaaccacgaccccaatacttaacttaccgttacgtttaccacgttcttacgttagggttacggggtttacggggttaacgtttacgtttacgttaccctttaacgtttacgtaaccgtaccgggttcggggacccgtaacggggtaaaccttccggttacgggtaccctacccgttccgtcccgaaccgtaccggtacccctacccgaaccggaaccccgggtcccttaccggttcccccggg

SEQ ID NO: 359435 - DNA, 543 bp, Homo sapiens
  misc_feature: GZ8MTXP02GT9ZO.17.33.C11.1.454.CMB.2.raw
  modified_base (294)..(294): a, c, t, g, unknown or other
  misc_feature (294)..(294): n is a, c, g, or t
  modified_base (337)..(337): a, c, t, g, unknown or other
  misc_feature (337)..(337): n is a, c, g, or t
  modified_base (445)..(445): a, c, t, g, unknown or other
  misc_feature (445)..(445): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaaacctggacaagcaccaggcactcatttanagtaacaaacaaacaaaacactcctcggacccctgcccattcncagcctcccctcgtggggacaaagctcgccctgaccactgtctggtgtgcagcctgaggacgaggctagactattacgcgccttactcgttacttggtggtgtctgtncttagtcgggcgagggaccagctgaccgtactaagtcacgaccaaggcctccgcccccgtaacggtccaccttcgtccgttaccccaccctcctaccg

SEQ ID NO: 359436 - DNA, 575 bp, Homo sapiens
  misc_feature: GZ8MTXP02IDHEE.17.33.C11.1.454.CMB.2.raw
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (415)..(415): a, c, t, g, unknown or other
  misc_feature (415)..(415): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtcccgtctctgaaagacaggctccaccatcaccaaggaccacctccacaaaccaggtcgtccttanatnaccatactggaccctgtggacacagaccanatattactgttcacgtctctagttggttcggggattattacgtcccttactttgaacttcggtcggggacctaggggaccttcgtacggtccaccggttcctcccgaacgtaccggacccttcccgaaccgtaaaccggggtccctaacgtttcccccgg

SEQ ID NO: 359437 - DNA, 593 bp, Homo sapiens
  misc_feature: GZ8MTXP02JAS88.17.33.C11.1.454.CMB.2.raw
  modified_base (293)..(293): a, c, t, g, unknown or other
  misc_feature (293)..(293): n is a, c, g, or t
  modified_base (316)..(316): a, c, t, g, unknown or other
  misc_feature (316)..(316): n is a, c, g, or t
  modified_base (335)..(335): a, c, t, g, unknown or other
  misc_feature (335)..(335): n is a, c, g, or t
  modified_base (454)..(454): a, c, t, g, unknown or other
  misc_feature (454)..(454): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggttccagcagaacctggacaagcaccaggcactcatttanagtaacaaacaacaaacactccncggacccctgcccgattcncacggctcccctccgtggggcaaagctcgccctgacactcgtcgtggtgtcgcagccgtggaggacgaggctagactagttctgacctacttccttacgtttggtcggttgcttggtancgttacgttcgggcgggaacggggaccaacggtcgtacggtacccgttacgttaaacggtccgacggacccgaacgggtccgttccgcccccgtcggtacctaccgttcctccgtttcccctaccccttctttaccccg

SEQ ID NO: 359438 - DNA, 558 bp, Homo sapiens
  misc_feature: GZ8MTXP02JNJ0T.17.33.C11.1.454.CMB.2.raw
  modified_base (525)..(525): a, c, t, g, unknown or other
  misc_feature (525)..(525): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaacggccctggagtggcttgcgctcatttagtgggatgagagtaagcactacagtcccgtctctagaagaacaggctccaccatacaaccaaggaccaccctccaacaaaccgaggtacgtaccttaacaaatcgaaaccaatatcggaccctggtacgacacagccactatattactgttacacgtctctagtgggttacgggtattattacgtccttagttgactacgtcggggccagggaactcgtcggtcaccgtcnccgcacgcctaccaccgaacggcccagttcccg

SEQ ID NO: 359439 - DNA, 534 bp, Homo sapiens
  misc_feature: GZ8MTXP02JFGI6.17.33.C11.1.454.CMB.2.raw
  modified_base (297)..(297): a, c, t, g, unknown or other
  misc_feature (297)..(297): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtaacaaacaacaaaacactcctcggacccctgcccgattctcaggctccccctcttggggcaaagctcgccctgacactgtctggtgtgcagcctgaggacgaggctgactatactgcctactctactttggtggtgcttgtgctagttcggcggaggaccaagctgaccgtacttagtcagtacccgaagcctcgccccctggtccactcgtcgttccccacccttccttcccg

SEQ ID NO: 359440 - DNA, 587 bp, Homo sapiens
  misc_feature: GZ8MTXP02GMKCI.17.33.C11.1.454.CMB.2.raw
  modified_base (210)..(210): a, c, t, g, unknown or other
  misc_feature (210)..(210): n is a, c, g, or t
  modified_base (297)..(297): a, c, t, g, unknown or other
  misc_feature (297)..(297): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtncttccaacactggagcagtcaccagtgcttactataccaaactggttccagcagaaacctggacaagcacccgaggcactcatttanagtaacaaacaacaaaacactcctacggacccctgccccgtattcctcacggtcctccccctccgttggggacaaagctacgcctgacactgtctggtgtgcagcctgacggacgacggctagacctagttactcgtacctacttcttactttgggtggttgcgttgtcgtcgttagttcggcgggacgggaccgaagcgtacgtaccggtacttaaaggtccgagacccgaaggccgtccgtcccccgtcggtccaccttccgtccgttccccgccccttacctttccg

SEQ ID NO: 359441 - DNA, 656 bp, Homo sapiens
  misc_feature: GZ8MTXP02FWRFD.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctgggtcctacgctggtgaaacccacacagaccctcacgctgacctgccaccttctctggcttctcactcagaacgagtggaatgggagtgggctggatccgtcacgccccaggaaacggccctggagtggctgcgctcatttagtggatgagagtagcactacagtccgtctctagaagaacgaggctaccaccataccacaacggaccacctccaaccaaaccgaggtacgtaccttaacaactacgaaacctaatacgtcggaccctgtcggacacgacgacccataatattacgtgttacacgtctcgtaaggttgggttaccggggtagtttacgttacggttacccttacgtttacggaaccgttacgggtacgggggtaccgtaaacgggggtaaacccttcgggttacggttacccgaaacccggttccgtacccgaaccgaaaccgtccccgttaccccgaaacccggaaccggggtcccctacggtttcccccggg

SEQ ID NO: 359442 - DNA, 628 bp, Homo sapiens
  misc_feature: GZ8MTXP02INI4K.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtggggagtggggctggactccgtcacgccccgaggaaacggccctggagtggcttgcgctcattagtgggatgagagtaagcactacagtccgtctctagaagaacaggctccaccatcacaagaccacctccaacaaaccaggtacgtacccttaacaatcgaacctaaatatacggaccctaggtacgacacaacgacccaatactattactcgttcacggtcttactaggttacggggtcggggtaagtttacgtttacgtcccgtttacgtttgacgttacggttcgggggacccgtaggggtaacccttcggtccggtaccgtacccggtccttccggaaccacgtcccgtaccccgaaccgaaaccggggtccccctagtttcccccggg

SEQ ID NO: 359443 - DNA, 589 bp, Homo sapiens
  misc_feature: GZ8MTXP02GB3S7.17.33.C11.1.454.CMB.2.raw
  modified_base (463)..(463): a, c, t, g, unknown or other
  misc_feature (463)..(463): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaaacggccctggagtggctgcgctcatttagtggatgagagtaagcactacagtccgtctcgtagaaagaacaggctaccaccactcaaccaacggacaccctccaacaaaaccgaggttacgtaccttaacaacgtacaaacctaaatagtacggaccctaggtacgacacacgaccaacatacttactcgtacaccgtntctagtgggttacggtagttattacgtccttacttcgtactacggtcgggaccaggggtaacctcgtcggtcctaccgtccgtaccgccacgccctacccaccgaacgggtccctacgttccccgg

SEQ ID NO: 359444 - DNA, 679 bp, Homo sapiens
  misc_feature: GZ8MTXP02HBP9G.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccgaggaaacggccctggagtggcttgcgctcatttatgggatgagagtaagcactacagtccgtctctagaaagaacaggctacccaccactaccaaccaaggaccaccctccaaaccaaaccgagggtacgtaccttaacgaatacgaaaccctaagttacgtacggtacccgtaggtacgaaccgacacgtacccaactattaactttaacgtcgtttacacggtctacgttagttggggttcgggtaagtttacttacggttccccttagtttcgaaccttacggtacggggtaccgaacggggtaaccttcgttacgggttacccgaacccggttccgttacccggaacccttacggacccccgttacccgaaaccccggtaaaccgggggcccccctaaacggtttccccccggg

SEQ ID NO: 359445 - DNA, 669 bp, Homo sapiens
  misc_feature: GZ8MTXP02HAMNF.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaaaggccctggagtggcttgcgctctatttagttgggatgagagtaagcactacagtcccgtctctgaaagaacaggctaccaccataccaaccaacggaccaccctccaacaaaaccaggtcgtaccttaacgaaatacgaaacctaaatactcggaaccctgtacggaacacgagaccaacattaacttacttgttacacggtctaccgttagtcgggttaccggggtagttttaacttacggttacccttacgtttacgtaacgttaccggttacgggggaccccgtaagggggtaaccctttccgttacgggggttacccaacccgggtttcctccccggccgttaaccggccccttaccccgaaacccggaaaccggggtccccctaacggtttcccccggg

SEQ ID NO: 359446 - DNA, 602 bp, Homo sapiens
  misc_feature: GZ8MTXP02G4E1S.17.33.C11.1.454.CMB.2.raw
  modified_base (306)..(306): a, c, t, g, unknown or other
  misc_feature (306)..(306): n is a, c, g, or t
  modified_base (349)..(349): a, c, t, g, unknown or other
  misc_feature (349)..(349): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgcttccaacactggagcagtcaccagtgcttactactaccaaactggttaccagcaacgaaacctggaacaacgcacccgaggcactctatttanagtaacaaacaacaaacactcctcggacccctgccgtattccncacggcctccccgtccgttcggggacaaagcctacgccctgacctactcgtcgtagtagtcgtcgacgagtcccgtagacggacggagcgtagacttatacgtcgtactacttcttacgtttggtgtgtcgtgtcgtagtcgttcgggcggacgggacacggcgtacgtaccgttacgttaacgtcgaacgaccgtacgtccgtcccgaacccgtcggtacctaccttccttcccggtccccgtcccttcccg

SEQ ID NO: 359447 - DNA, 577 bp, Homo sapiens
  misc_feature: GZ8MTXP02IXKUD.17.33.C11.1.454.CMB.2.raw
  modified_base (297)..(297): a, c, t, g, unknown or other
  misc_feature (297)..(297): n is a, c, g, or t
  modified_base (373)..(373): a, c, t, g, unknown or other
  misc_feature (373)..(373): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcaagaaacctggacaagcacccgaggcactcatttanagtaacaaacaacaaacactacctcggaccccctgcccgtattcctcacggcctccccctccgtggggacaaagcncgccctgaccactgtctggtgtgcagctgaggacgagctgactatactgacctactcttactttggtggtgcgttgtgcgttagttcggcgggtaaggggaccaaggtctacggtaccgttacgttaaacgtcgacgtacccgaacgggtcctccgtcccccgtggtccctactcctccgtttcccccgtcccttcccttaccg

SEQ ID NO: 359448 - DNA, 623 bp, Homo sapiens
  misc_feature: GZ8MTXP02F35FY.17.33.C11.1.454.CMB.2.raw
  modified_base (300)..(300): a, c, t, g, unknown or other
  misc_feature (300)..(300): n is a, c, g, or t
  modified_base (425)..(425): a, c, t, g, unknown or other
  misc_feature (425)..(425): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttcccagcaagaaacctggacaagcacccaggcactcatttaanagtaacaaacaaacaaaccactaccgtacggaccccctgcccgtacttctcgacggtcctccccctccgttggggacaaacgctcgccctgacacgtcgtcgtgtgtcgctacgcgtgaggacgnggctgacttattacgtgtacctacgttccttacgtttggtcggttgtcgtggttgtcgttagtcggggtcgggtaacgggaccgtaaaggccgtacgtaccgttacgttaaggtaccgacggtacccgaacggtcctacccggtcccccttcgggaccctaccgtccttaccgtccccctaccccgttcctttacccg

SEQ ID NO: 359449 - DNA, 595 bp, Homo sapiens
  misc_feature: GZ8MTXP02JBXL0.17.33.C11.1.454.CMB.2.raw
  modified_base (295)..(295): a, c, t, g, unknown or other
  misc_feature (295)..(295): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttanagtaacaaacaacaaaacactcctacggacccctgcccgattctcaggcctcccctcgtggggcaaagctcgccctgacactgtctggtgtgcatccgtgacggacgaggctgacttattactgccttactcttacgtttggtggttgcgtgtgcgttagtcggtcgggaggtaccgaagcgtacggtacccgttacgttaaacggtacgaacggacccgtaacggcccgtcccggtacccccgtcgggtccctaaccgttcccgttcccggtttcccccgtccccgttccctttacccg

SEQ ID NO: 359450 - DNA, 525 bp, Homo sapiens
  misc_feature: GZ8MTXP02JMRDV.17.33.C11.1.454.CMB.2.raw
  modified_base (413)..(413): a, c, t, g, unknown or other
  misc_feature (413)..(413): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaaacactcctggacccctgcccgattctcaggctcccctccttggggcaaagctgccctgacactgtctggtgtgcagcctgagacgaggctgacctattacngcctactctactttggnggtnctggtgctagttcggcggagggacccaagctgaccgtcttaaagtcagcccaaggctcgcccctggcacgtctcgtcccgtcctccttacc

SEQ ID NO: 359451 - DNA, 737 bp, Homo sapiens
  misc_feature: GZ8MTXP02IAWSN.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtcccaggaggacagtcactctcacctgtcgcttaccaacacgtggagcagtccaccgagtcgtactttactactacctaaacgttcggttccagcaacgaaaccgtaggaacaacggccaacccgaggcactactatttatacgtaaacaaaacaaacaaaacactaccgtaccggacccctcgaccgtactcctaccgacggtcctcccccgtccggttcggggacaaacgcgttccgacccgtcgaccttacgtcgttccgttgggtcggtcgaccgacgtcccgtaggaacgggaacggacgggtacgttacggtaacctttaacgtttaacgtccggttacccgttaccttaccgttttacccgggtttttggggttcgggtttcgtccgtttgggttcgttacccgtttaaggttccggggacggggaaccggtaacgacgtccgttacggtaccgttacgtttaacgactaaccggaccgtaacggccgttcccgccccgttccggtcctcccgttcgttccccggttccccgtcccctttcccgttcccg

SEQ ID NO: 359452 - DNA, 583 bp, Homo sapiens
  misc_feature: GZ8MTXP02GMT1W.17.33.C11.1.454.CMB.2.raw
  modified_base (322)..(322): a, c, t, g, unknown or other
  misc_feature (322)..(322): n is a, c, g, or t
  modified_base (375)..(375): a, c, t, g, unknown or other
  misc_feature (375)..(375): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaacggccctggagtggcttgcgctctatttatggatgagagtaagcactacagtccgtntctagaaagaacaggctaccaccatacaaccaacgaccacctccaacaaacgnggtcgtaccttaacaatacgaaccaatactcgaaccctgtacgacacacgaccactatacttactgttacacgtctactagtgggttacgggatttagttacgttacccttactttacgacgttacgtcggggaccaaggggtactcgtacggtaccgtaccgtctccgcgacgccctaccgaccgaacggcccctacgtttccccgg

SEQ ID NO: 359453 - DNA, 617 bp, Homo sapiens
  misc_feature: GZ8MTXP02JINDS.17.33.C11.1.454.CMB.2.raw
  modified_base (315)..(315): a, c, t, g, unknown or other
  misc_feature (315)..(315): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttagtgggatgagagtaagcactacngtccgtctctagaagacaggctccaccataccaaccaacggacccacctccaaccaaaaccgtacggtacgtaccttacaaatacgaaacctaattacgtcggaccctgtacggaacaccacgaccactattaacttacgtcgttaccacgtctcgttagttcggggttacggggtagtttagttaccgtccgtttacgtttcgacttacggtcgggggaccgaagggtaacctcgtacggtccgtaccgtcgtcccgcgaccgtaccctaccgacccgaacgggaccctacgtttccccgg

SEQ ID NO: 359454 - DNA, 631 bp, Homo sapiens
  misc_feature: GZ8MTXP02H70DP.17.33.C11.1.454.CMB.2.raw
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggactccggtcacgaccccgaaggaacggccctggagtggctgcgctctatttagtgggatgagagtaagcactacagtccgtntntagaagaacngctccaccactacaaccgaagacccaacctccaaaccaaaccgacgggttacgtaccttaacaaattacgaaaccctaagtacgtacgggtaacccttggacggaaccacgagaccccatattattactgtttacacgtcttcgtagtggggtttacgggtattagttaccggtaccctttagttacgacgttaccggtggggcccgaaaggggtaccttcggtcggtaccctaccggttcctccggccaccgtcccgtcccaaaccggaaccggcccttacgtcccccgg

SEQ ID NO: 359455 - DNA, 592 bp, Homo sapiens
  misc_feature: GZ8MTXP02IWU9N.17.33.C11.1.454.CMB.2.raw
  modified_base (297)..(297): a, c, t, g, unknown or other
  misc_feature (297)..(297): n is a, c, g, or t
  modified_base (320)..(320): a, c, t, g, unknown or other
  misc_feature (320)..(320): n is a, c, g, or t
  modified_base (339)..(339): a, c, t, g, unknown or other
  misc_feature (339)..(339): n is a, c, g, or t
  modified_base (560)..(560): a, c, t, g, unknown or other
  misc_feature (560)..(560): n is a, c, g, or t
  modified_base (578)..(578): a, c, t, g, unknown or other
  misc_feature (578)..(578): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactggttccagcaagaactggacaagcacccaggcactcatttanagtacaaacaacaaaacactccncggacccctgcccgattcncaggcctccccctccgttggggacaacgtctcgccctgacactcgtctggtgtgcagcctaggaggacggaggtctcggtaaccttattactcgcccttacttcgttacgtttgggtggtgtcgtggtgtcgttagttcggggcggtaacgggaccaacgcgtacggtaccgttcgttaaagtccgacgacccgaacgcctccgtcccccgtcggtacccncttccgtccgttcccccncccttcccttcccg

SEQ ID NO: 359456 - DNA, 617 bp, Homo sapiens
  misc_feature: GZ8MTXP02I88NF.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgccaccttctctggcttctcactcaagaacgagtaggaatggggagtgggctggactccgcacgccccaggaacgcctggagtggcttgcgctctatttagtgggatgagagtaacgcactacagtccgtctctagaagaacaggctaccaccactacaaccgaacggacccaccctcccaaaccaaacccgtaggttacgttacccttaacaattacgaaccaaatactcggaccctggtcgaacacgagccaatataacttactcgttacacgtctcgttacgttgggtacgggtagttacttacgttaccctttagtttcgaacgttacgtcggggacctaagggtaacttcgtacggtcccaccggttctccggcacgtccctacccgacccgaacgggcccctacgtttccccgg

SEQ ID NO: 359457 - DNA, 613 bp, Homo sapiens
  misc_feature: GZ8MTXP02HBWWQ.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccgaggaggacagtcactctcacctgtgcttccaacactggagcagtcaccagtgcttacgatccaaactggttccagcagaaacctggacaagccaccaggcactcatttatagtaacaaacaacaaacactcctcggacccctgcccgtattcctcgacggcctcccccgtccgttggggaccaaagctcgccctgaccacgtgtcgtggtgtgcagccgtgacggacgaggcgtagacttattactcgtacctactcttaacgtttggtggtgtcttgtgtcgtagttcgggcggaacggaccgaaggcgtacgtaccgttacgttaaacgtcgacggacccgaaacggtccctacccggtcccccgttcgggtcccttaccgttccgttcccgttacccccggtccccgttacccgtttaaccccg

SEQ ID NO: 359458 - DNA, 531 bp, Homo sapiens
  misc_feature: GZ8MTXP02FEQL3.17.33.C11.1.454.CMB.2.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggaggggacagtcactctcacctgtgcttccaacactggagcagtcaccagtgcttactatccaaactggttccagcagaaacctggacaagcacccagggcactcatttatagtacaaacaacaaaacactcctggacccctgcccgattctcaggctccccctccttgggggcaaagctgccctgacactgtctgtgtgcagcctgaggacgaggctgactattactgcctactctactttggtgtgctgtgctattcggcggagggaccaagctgaccgtcttaagtcagcccaaggcctcgcccccgtcggtcactctcgtttccccaccctcctacccg

SEQ ID NO: 359459 - DNA, 579 bp, Homo sapiens
  misc_feature: GZ8MTXP02H6226.17.33.C11.1.454.CMB.2.raw
  modified_base (301)..(301): a, c, t, g, unknown or other
  misc_feature (301)..(301): n is a, c, g, or t
  modified_base (319)..(319): a, c, t, g, unknown or other
  misc_feature (319)..(319): n is a, c, g, or t
  modified_base (420)..(420): a, c, t, g, unknown or other
  misc_feature (420)..(420): n is a, c, g, or t
  modified_base (454)..(454): a, c, t, g, unknown or other
  misc_feature (454)..(454): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtcaccagtgcttactataccaaactcggttccagcaagaaaccgtgaacaagccaccaggcactcatttanagtaacaaacaacaaacnctcacgaccctgccatctcacgtcctcccctcgtaggggacaacgctcgcctgacactgtcgtgtgtgcacgccgtgacggacgaggctgtaactattacncgtactactcttacgtttggtgtgtctgtacgtntacgtcgggacggtacgggaaccaagtcgacgtacccgtacttaacgtaccgacgacccgaacgtccgtccggcccccgttcggtcctaccgttccgtccgttcccccgtccccttccgtacccg

SEQ ID NO: 359460 - DNA, 685 bp, Homo sapiens
  misc_feature: GZ8MTXP02GMUHC.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcacgccccgaggaacggccctggagtggcttgcgctctatttagtgggatgagagtaagcactacacgtccgtctctagaaagaacaggctaccaccatacaaccaaggaccacctccaaacaaaccgtacggttcgtaccttaacaaacgttacgaaacccaattaacgtcggtaacccctggtacggaaccacacgaacctacaattacttactacggttccaaaccggtcttacgttaggttcgggggtttacgggggtactttaacgtttacggttaacccctttacgtttacgtaaccgttacgggttacgggggtaccgtaacggggtaaacctttcggtacggtaccgtaaccccggttccgttcccggaaccgaccggtccccttaccccgaaccgtaacccgggcccctaacggtttcccccgg

SEQ ID NO: 359461 - DNA, 522 bp, Homo sapiens
  misc_feature: GZ8MTXP02GMQ1Q.17.33.C11.1.454.CMB.2.raw
  modified_base (381)..(381): a, c, t, g, unknown or other
  misc_feature (381)..(381): n is a, c, g, or t
  modified_base (400)..(400): a, c, t, g, unknown or other
  misc_feature (400)..(400): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaggccctggagtggcttgcgctcatttattgggatgagagtaagcactacagtccgtctctgaagacaggctccaccatcacagacactccacaaacagtgtcctacatgaccaatangaccctgtgacacagccanatattactgttcacgctctagtgggttcgggagttattagtccctatttgactacgtggggccagggactcgtcggtccaccgtctccgcgacgccctacccacaacgggcccagtccccgg

SEQ ID NO: 359462 - DNA, 619 bp, Homo sapiens
  misc_feature: GZ8MTXP02JJJR4.17.33.C11.1.454.CMB.2.raw
  modified_base (180)..(180): a, c, t, g, unknown or other
  misc_feature (180)..(180): n is a, c, g, or t
  modified_base (349)..(349): a, c, t, g, unknown or other
  misc_feature (349)..(349): n is a, c, g, or t
  modified_base (367)..(367): a, c, t, g, unknown or other
  misc_feature (367)..(367): n is a, c, g, or t
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
  modified_base (552)..(552): a, c, t, g, unknown or other
  misc_feature (552)..(552): n is a, c, g, or t
tcagcgtagactagcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggccaacatagccttctccgtccccccttgcagtaacaccaagtacagaatattaacctgttcccatcgactacgccttcggcctcgcctagggcactcaccctgccccgattaacgtgacaggacctgtctcggngagcggtctttcaccgtntttatcgttaccttatgtcagctattcgctacttcngactacctcagcatcgccctnaacagccactccttacacacgtcttaaacacgaacgtccctacccccaacccgaaacaacgccaaataacgcgtcgctccgccgcacggtccttacgggtcacgtaaacgtttcggggtttaaacccncccccgtttttacgaacgttccccgtttcccccgacctacttccctacggttaccctaagtttcccg

SEQ ID NO: 359463 - DNA, 599 bp, Homo sapiens
  misc_feature: GZ8MTXP02JPCMD.17.33.C11.1.454.CMB.2.raw
  modified_base (227)..(227): a, c, t, g, unknown or other
  misc_feature (227)..(227): n is a, c, g, or t
  modified_base (299)..(299): a, c, t, g, unknown or other
  misc_feature (299)..(299): n is a, c, g, or t
  modified_base (323)..(323): a, c, t, g, unknown or other
  misc_feature (323)..(323): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggancagtcaccagtgcttactataccaaactggttacagcaagaacctggacaagcaccgaggcactctatttanagtaacaaacaacaaacactaccncggacccctcgcccgtattcctacacggtcctcccctcgtcggggacaaacgctcgcctgacctactcgtcgtggtgcgtcacgcctaggacggacggaggtctacgtactattactcgtacctacttcgttacgtttggtcgtgtcgttgtgtcgtagttcgggcggtacggaccgagtcgtacggtaccgtacgttaacgtacgacgtaccgacggtccgtcccgtccccgtcggtcctaccgttccgtaccttcccctacccttccttacccg

SEQ ID NO: 359464 - DNA, 608 bp, Homo sapiens
  misc_feature: GZ8MTXP02JNMUW.17.33.C11.1.454.CMB.2.raw
  modified_base (351)..(351): a, c, t, g, unknown or other
  misc_feature (351)..(351): n is a, c, g, or t
  modified_base (406)..(406): a, c, t, g, unknown or other
  misc_feature (406)..(406): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactataccaaactggttccagcaagaaacctggacaagccaccaggcactctatttatataacaaaacaaacaaaaccacctaccgtacgacccctcgaccctattccncgacgcctccccctcgttcggggacaaacgctcgcctgacactgtcgtggtcgtncgacgccgtggacggaacgtggacgtagtacttattaccgtacgtcctacttaccttacgtttgggtggttgcgttggtcgtacgtacgttcggggacgggtaggaccgtaacgcgtacggtaccgttcgttaacgtcgacggaccgacgccgtccgcccccgtgtcccgtactccgttcccgtccctccctcccttacccg

SEQ ID NO: 359465 - DNA, 602 bp, Homo sapiens
  misc_feature: GZ8MTXP02GC9LY.17.33.C11.1.454.CMB.2.raw
  modified_base (175)..(175): a, c, t, g, unknown or other
  misc_feature (175)..(175): n is a, c, g, or t
  modified_base (185)..(185): a, c, t, g, unknown or other
  misc_feature (185)..(185): n is a, c, g, or t
  modified_base (213)..(213): a, c, t, g, unknown or other
  misc_feature (213)..(213): n is a, c, g, or t
  modified_base (395)..(395): a, c, t, g, unknown or other
  misc_feature (395)..(395): n is a, c, g, or t
  modified_base (436)..(436): a, c, t, g, unknown or other
  misc_feature (436)..(436): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccanacagaccctnacgctgacctgcaccttctctggcttcncactcagaacgagtgaatggggagtgggctggatccgtcacgccccgaggaaacggccctggagtggcttgcgctcgtatttagtgggatgagagtaagcactacagtcctctacgtagaaacgaacgaggctaccaccatcaacgaacgaccacctccaacaaaccgtggtcgtacctaanaatacgaaccaatcacgaaccctgtacgacacagaccctanagttacttacttcgtcaaccgttctacttaggtggttacggggtatttacgtacgttaccttagttacgtacgtacggtcggggacctaaggggtaccttcggtggtaccctaccggttacccgaccgcgtaccgacctaccgaccggaccggtccgtacgtcccg

SEQ ID NO: 359466 - DNA, 591 bp, Homo sapiens
  misc_feature: GZ8MTXP02IDZYP.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggaggacagtcactctcacctgtgcttccaacactggagcagtcaccagtgcttactataccaaactggttccagcaagaaacctgaacaagcacccgaggcactcatttatagtaacaaacaaacaaaacactcctcggacccctcgcccgattcctacacggcctcccccgtccgttcggggacaaacgctcgccctgacctactcgtcgtcggtgtgcacgccgtggaggacgaggctgacttattactcgtcctactccttacgtttggtggttgtcgttgtgtcgttagttcgggcggtacgggaccagtcgtcgtaccgttacgttaaacgtcacgaccgacgccctccgcccccgtcggtcctaccttcctccgttacccctcccttcctttacccg

SEQ ID NO: 359467 - DNA, 259 bp, Homo sapiens
  misc_feature: GZ8MTXP02GNJWA.17.33.C11.1.454.CMB.2.raw
  modified_base (258)..(259): a, c, t, g, unknown or other
  misc_feature (258)..(259): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagcgggctggcaaggcgcatagnn

SEQ ID NO: 359468 - DNA, 577 bp, Homo sapiens
  misc_feature: GZ8MTXP02IESTP.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttcccagcagaaacctggacaagcacccagggcactcatttatagtacaaacaacaaaacactacctgaccccctgcccgattctcaggctccccctccgttggggcaaagctagccctgcactgtctggtgtgcagcctggagacgaggctgactattactgcctactcttacgttggtggtgtcttgtgtcttagtcggtggacggggtaccaaaggtctacgtaccgttacgttaacgtcgacgcccgtaaacggcctccggtccccccgtaacgggtccctaccgttcgtccggttcccccgtccccttccccgttccg

SEQ ID NO: 359469 - DNA, 602 bp, Homo sapiens
  misc_feature: GZ8MTXP02JMPZ3.17.33.C11.1.454.CMB.2.raw
  modified_base (297)..(297): a, c, t, g, unknown or other
  misc_feature (297)..(297): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcaagaaacctggaacaagcaccgaggcactcatttanagtaacaaacaacaaacactcctacggacccctgcccgattcctcacggtcctccccccgtccgttggggacaaacgctcgccctgaccacgttgtccgtggtcgtcgcgacgccgtaggacggacgaggtcgtgtactatacgtgtcctacttcttacgtttggtgtgtcgtgtgtacgttagttccgggcgggaacggtaccgaagtcgtcggtaccgtcgtttaaacgccgacgacccgaacggtcctccgccccgttcggtacctccgtttccgtccccgtccccttccctaccgttaccg

SEQ ID NO: 359470 - DNA, 694 bp, Homo sapiens
  misc_feature: GZ8MTXP02GGAN6.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaacggccctggagtggcttgcgctctatttagtgggatgagagtaagcactacagtccgtctctagaagaacaggctccaccatcaccaagaccacctccaacaaaccgaggtcgtaccttaacaatcgaacctaatacgtcggaccctgtacgaacacacgaccaactattaacttacgttacgtttaccaaccgtcttaccgttaggttacggggtttaccgggggttaagttttaacgtttacggttaccccctttaacgttttacgtaaaccgtttaaccgggtacgggggtaacccgtaaagggggtaaaccctttccggttacgggttaccccgtaacccggttcccgttaccccggaaccgtaaccggtcccccttacccggaacccgaaaaccgggggtccccctaaggtttccccccgggg

SEQ ID NO: 359471 - DNA, 862 bp, Homo sapiens
  misc_feature: GZ8MTXP02GIFBH.17.33.C11.1.454.CMB.2.raw
  modified_base (297)..(297): a, c, t, g, unknown or other
  misc_feature (297)..(297): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtcaccagtgcttactatccaaactggttccagcaagaaacctggacaagcaccaggcactcatttanagtacaaaacaacaaaacactcctacggaccccctgacccgtaacttcctacaacgggtcccttccccccgttcccggtttacggggggaccaaaaacggtcccgttacgcccccgttacggaaccaaccgtttggttacccgttggggttacgttcggaccgaacggtcccgttagggaaacggggaacccggaaggggtaccgttaacggtaaaccgtttaaactttaaacccgtccggtaccccctttaacctttacccgtttaaaccggtttttggggtttacgggtttcgtccgtttcgggttaggtaacccgtttaacggtttcccgggggtaaccgggggtaaaacggggtaaccccgaaaacggggttcccgttaaccgggttaaaaccccggtttaccgttttaaaaacggggtcccgtaaaccgggtaacccccgaaaacgggggtacccccttaccccgggtaccccccccggttccgggtttacccctaaccccgtttcccgtttaccccggtttacccccccgtaaccccccgtttccccgtttaacccccg

SEQ ID NO: 359472 - DNA, 723 bp, Homo sapiens
  misc_feature: GZ8MTXP02IBAH5.17.33.C11.1.454.CMB.2.raw
  modified_base (188)..(188): a, c, t, g, unknown or other
  misc_feature (188)..(188): n is a, c, g, or t
  modified_base (279)..(279): a, c, t, g, unknown or other
  misc_feature (279)..(279): n is a, c, g, or t
  modified_base (346)..(346): a, c, t, g, unknown or other
  misc_feature (346)..(346): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagacccctnacgctcgacctgcctaccttctctggcttctcactcaagaacgagtggaagtggggagtgggctggatcccgcacgccccaggaacggccnggagtggctgcgctctatttagtgggatgaagagtaagcactacacgtccgtctctagaaagaacgnggctcccaaccacgtaccaaaccgaacggacccaacccctaccgaaacccgaaacccgtagggttaccgtacccttaacaaacgtacgaaaccctaaattaacgtcggaacccgttggtaacggaacaccgacgtaccctaaactattaactttaaccttcgtttaccaaccgtccttcgttagggtttacggggtttaccgggggttaattttacgtttacgtttaccccgtttacttttacggaaccgttacgggttcgggggaccgtacggggtaacctttccggtacggttcccgtaacccggttcctccccggtaacacccggtaccctacccggaaacccggaccggggtacccctacggtttcccccggg

SEQ ID NO: 359473 - DNA, 669 bp, Homo sapiens
  misc_feature: GZ8MTXP02HX252.17.33.C11.1.454.CMB.2.raw
  modified_base (229)..(229): a, c, t, g, unknown or other
  misc_feature (229)..(229): n is a, c, g, or t
  modified_base (305)..(305): a, c, t, g, unknown or other
  misc_feature (305)..(305): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtcgcttaccaacactggancagtcaccagtgacttactataccaaactggtccagacagaaacctgacaagaccaccgaggcactactatttaanagtaacaaaacaaacaaaaccactaccacggacccctcgaccctacttctaccgacgtacccttcccccgtccggttacgggggaccaaaacggtcctaccggtccctaggacctacgttcggtccgttggggtgtcgacgacgaccgtaggacggacggaggacgttacgtaacgttacttacgtcgtacccttactactttacggtttggttcggttgtcgttgtcgtcgttacggtcgggtacgggacgggaacctaagtcgtacggtaccgttacgttaaacgcctacggaccgacggtcctcccggtccccgtccggtctaccgttccgttccgttcccccgtccctttaccgttcccg

SEQ ID NO: 359474 - DNA, 703 bp, Homo sapiens
  misc_feature: GZ8MTXP02IVLY7.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctggcttctcactcagaacgagtggaagtggggagtgggctggactccgtcacgccccgaggaacggccgtggagtggctgcgctctattagtggatgagagtaagcactacacgtccgtctactagaaagaacgacggacctacccaaccactaccaaaccgaaacggacccaaccctacccaaaccaaaaccgacgggttaccgttaacccttaacaaacttacgaaaccctaaatacgtacggtaccctaggtacgaacacgaacgacccaatacttaacgtttaaactcggttaccaaccgttcgttacgttacgggttaggggttacgggtaacgttttacgttacggttacccctttagtttcgaacgttaccggtacggggaccgtaaacggggtaccttacggtcggtacccgtcccggttaccgtcccgtaacgacccgtacccgtacccgaacccggtaaaccggtcccgttaaccgtttcccccggg

SEQ ID NO: 359475 - DNA, 587 bp, Homo sapiens
  misc_feature: GZ8MTXP02IVJQL.17.33.C11.1.454.CMB.2.raw
  modified_base (331)..(331): a, c, t, g, unknown or other
  misc_feature (331)..(331): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaatgggagtgggctggatccgtcagcccccaggaaacggccctggagtggcttgcgctctattatgggatgagagtaagcactacagtccgtctctgaaanacaggctccaccatcacagacacncacaacngtgtcctanatgacatancgaccngtgacacagcaacatattactgttacacgtcttacgtagttcgggttcgggggtatttacggttaccttactttacgttacgtacgttacggggtaccgacggtaaaccggttacttcgggtccgtacccgtaccgtcccggactaaccgtcccgttacccgaaaccaccgggaccccgtaaccgttccggtttcccccgg

SEQ ID NO: 359476 - DNA, 630 bp, Homo sapiens
  misc_feature: GZ8MTXP02I8UBJ.17.33.C11.1.454.CMB.2.raw
  modified_base (453)..(453): a, c, t, g, unknown or other
  misc_feature (453)..(453): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccgaggaaacggccctggagtggcttgcgctctatttagtgggatgagagtaagcactacagtccgtctctgaaagacaggctccaccataccaaccaaggaccaaccctccaaaccaaaccgaggtacgtaccttaacaatcgaaccaatactacggaaccctggtacgaacacgacgaccaactattacttacngtttacacgtctacgttagtgggttacgggtaatttacttacgttcccttacgtttgaccgttacggtcggggacccgtaggggtaaacccttcggttacggtccctaacccggttcctacccggaacaaccggtcccctacccgaaccgaaccggggtccccaacgtttcccccgg

SEQ ID NO: 359477 - DNA, 726 bp, Homo sapiens
  misc_feature: GZ8MTXP02HX1OQ.17.33.C11.1.454.CMB.2.raw
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctggcttctcactcagaacgagtggaatgggagtgggctggactccgtcacgccccaagggaacgccctggagtggcttgcgtctctatttagtggatgagagtaagcactacgacgtccgtctacgtagaaagacgaggctacccaccataccaaccgaacggacccaaccctacccaaacgaaaaccgtacgggttaccgtaaccctttaacgaaacttaccgaaaccctaaagtaacgttacccggaaccccgttaggtaccggaaccaaccgacgaaccccaaactattaacttacgttcgtttacaacgtccttacgtaggttacgggtttacgggggtaaactttacgtttaccggttacccctttaacgttttacggaaaccgttaccggtacgggggtacccgtaaacggggtaaaccttccgggttacggtacccgtaacccgtttccgtcccgaaccgaccggtaccccctacccggaaaccgaacccggggtcccctaacggttcccccgg

SEQ ID NO: 359478 - DNA, 619 bp, Homo sapiens
  misc_feature: GZ8MTXP02HH5YX.17.33.C11.1.454.CMB.2.raw
  modified_base (296)..(296): a, c, t, g, unknown or other
  misc_feature (296)..(296): n is a, c, g, or t
  modified_base (339)..(339): a, c, t, g, unknown or other
  misc_feature (339)..(339): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactataccaaactggttccagcagaaacctggacaagcacccaggcactcatttanagtaacaaacaaacaaaacactcctcggacccctgcccattcncacggctccccctcgtggggacaaacgctcgccctgaccacgtcgtcgtggtgtcgcgacgcctaggaacggacgaagtacgtagtaaccttaagttacctcgtaccttaacttccttacgtttgggtgttgtcttgtagtcgttacgttcgggacgggacggacccaagtcgtacggtaccgttacgtttaaacggtaccacggacccgaacggtccctccgtcccccgtcggtacccaccgttccgttaccgttccccctaccccgttcccttacccg

SEQ ID NO: 359479 - DNA, 566 bp, Homo sapiens
  misc_feature: GZ8MTXP02IQSWA.17.33.C11.1.454.CMB.2.raw
  modified_base (294)..(294): a, c, t, g, unknown or other
  misc_feature (294)..(294): n is a, c, g, or t
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
  modified_base (446)..(446): a, c, t, g, unknown or other
  misc_feature (446)..(446): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagcccctcactgactgtgtccccaggagggacagtcactctcacctgtgcttccaacactggagcagtcaccagtgcttactatccaaactggttccagcagaaactggacagcaccaggcactcatttanagtacaaacaacaaaacactcctcggacccctgacccgacttctcagtcctcccctccgttggggacaagctcgccctgacactgtctggtntgcagctgagacgngctgactatctgctactcttacgtttggtgtgctgtgctagtcggnggacggacaagcgtgtaccgtcgttaaacgtcgaacgtcccgaacggtcctaccgtcccccgtaacggttccttacgtttttccgttcccccggtccctttacccgttaccgtttacccg

SEQ ID NO: 359480 - DNA, 535 bp, Homo sapiens
  misc_feature: GZ8MTXP02FJ8A9.17.33.C11.1.454.CMB.2.raw
  modified_base (408)..(408): a, c, t, g, unknown or other
  misc_feature (408)..(408): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaacaaaacactcctcggacccctcgcccgtattcctcacggcctccccctccgttggggcaaagctacgccctgacactgtctgtgtgcagcctgaggacgnggctgacttattactgacctactcttacgtttggtggtgctaggtgtctagttcggcggagggaccaagctgacgtcttaagtcagcccagcctcgcccctcgtcactctcgtcccaccctctaccg

SEQ ID NO: 359481 - DNA, 613 bp, Homo sapiens
  misc_feature: GZ8MTXP02JJ4DW.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatcggcacgccccaggaacgcctggagtggcttgcgctctatttatgggatgagagtaagcactacagtccgtctactagaaagaacgaggctaccacatccaacagacaccctcaacaaaccaggtacgtaccttaacaaattcgaaaccctaattacgtacggtaccctggtacggaaccacgacgaccccaatataacgtttaccctgttacacgtcctgttacgttgggtaccgggggttattaagtttaccggtccttacgtttagactaacggtcggggacccagggtaactcggttcggtaccgtacccgttcgaccggccgaaccgtccgtacccgaccgaccggtacccgtaccgtccg

SEQ ID NO: 359482 - DNA, 564 bp, Homo sapiens
  misc_feature: GZ8MTXP02JMQN5.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtggctggatccgtcacgccccaggaaggccctggagtggcttgcgctcattagtggatgagagtaagcactacagtccgtctctgaaagacaggctccacatacacagaccactccaacaaacagtcgtacctacaatcgaaccaatactcggaaccctggtacgacacagacccaatacttattactgttaccacgtctcgttagtggttacgggtagtttattacgtcccttaacgttttgacttacggttcggggcccaaggggtacctcgtacggtccaccgtcgtaccgcacgccctaccaccgacggtccacgtttcccgg

SEQ ID NO: 359483 - DNA, 649 bp, Homo sapiens
  misc_feature: GZ8MTXP02HFGP6.17.33.C11.1.454.CMB.2.raw
  modified_base (418)..(418): a, c, t, g, unknown or other
  misc_feature (418)..(418): n is a, c, g, or t
  modified_base (462)..(462): a, c, t, g, unknown or other
  misc_feature (462)..(462): n is a, c, g, or t
tcagcgtagactagcacgaccggtgctcgatttagagtgagctcgttgggtttgggggcgccagggtcccttccaatatcagcaccatggcctggactcctctctttctgttcctcctcacttgctgcccagggtccaattctcagactgtggtgactcaggagccctcactgactgtgtcccaggagggacagtcactctcaccgtgtcgtccttaccaacacgtggacgactacgtccaaccgtagtcgtacttaactactaacctaaacgttcggttaccagacaacgaaaccgtggaacaacgaccaccgaggacactactatttaataacgtaaacaaacaaacaaactacctcgtaccgaccctcgaccgtactcctacgacgtcctccccgtccggtggggaacaacgtcncgcctgactcgtcgtcgtggtgcgcgacgtcgtaggacggacgnggctagtacctattacgtcgtaccttacttacgttcgtttgggtcgttgtcttggtcgttacgttacggtcggggacggacggaaccgtagtcgtaccgtacgttacgtacgtacgaaccgtaccgacgtccgtcccgtccccgtcggtacctccgttccgttcccgtcccgtccctttactacccg

SEQ ID NO: 359484 - DNA, 570 bp, Homo sapiens
  misc_feature: GZ8MTXP02IDK36.17.33.C11.1.454.CMB.2.raw
  modified_base (295)..(295): a, c, t, g, unknown or other
  misc_feature (295)..(295): n is a, c, g, or t
  modified_base (424)..(424): a, c, t, g, unknown or other
  misc_feature (424)..(424): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttcagcaagaaacctggacaagcaccaggcactcatttanaagtaacaaaacaaacaaaacactactcggacccctgcccgatcctcacggctccccctcgttggggacaaagtctgccctgacactcgtctgtgtgcacgcctggaaggacgaggctagactattacngactactcttacgtttggtgtnctgtcgtntagttcggcggtaacggaccaagctacgaccgtacgtttaacgacacggacccgaaaggtcctaccgcccccgttggtacctaccgtcgtccggtttccccctccctttacctccg

SEQ ID NO: 359485 - DNA, 617 bp, Homo sapiens
  misc_feature: GZ8MTXP02JLTB6.17.33.C11.1.454.CMB.2.raw
  modified_base (246)..(246): a, c, t, g, unknown or other
  misc_feature (246)..(246): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcatgctgacctgcaccttctctggcttctcactcagaacgagtggaatgggagtgggctggntcgcacgccccaggaacgcctggagtggcttgcgctctatttagtggatgagagtaagctactacacgtccgtctctagaacgacaggccctcacctactcaaccgaacggaccaccctaccaaacgtaaaccgtaggttacggtaccctttaacaaacttacgaaccctaaattacgacggtacccgtgtacggaccaacgacgaccactaattacttacgtgttaccacgtcttcgtaaggttcgggttaccgggtagtttattaccggttcccttaagtttcgacgttacggtcggggacccgagggtaacctcggtacgtcctaccgtcctaaccgctaacgccctacgaccgtaacggccctaccg

SEQ ID NO: 359486 - DNA, 743 bp, Homo sapiens
  misc_feature: GZ8MTXP02H8K4S.17.33.C11.1.454.CMB.2.raw
  modified_base (324)..(324): a, c, t, g, unknown or other
  misc_feature (324)..(324): n is a, c, g, or t
  modified_base (383)..(383): a, c, t, g, unknown or other
  misc_feature (383)..(383): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctagctggtgaaacccacacagaccctcacgctgacctgcaccttctctggcttctcactcagaacgagtggaatggggagtgggctggactcggtcacgaccccaggaacggcctggagtggcttgcgctctatttagtggatagagagtaagcactacagtccgtntctagaaacgaacaggcctaccaccatccaacgaacggtaccacccacaaaccaaaacnggttaccgtaccttaacaaattacgaaaccctaaagtacgtaccgggacccttagggtacgaaaccgaacgaaccgacccaaccgtaatttaaaaccttaccgggttgttttaaccccacggtacccttacttaaacggggttggggttttaaccgggggtaattttaacgtttaaaccggtttccccttttaaaacgtttcggtaaaccttaacgggttccggggaaccggttaacggggtaccctttaaccgttcgggggtttaaaccccctacccggttcccgtacccgtaacccgtaacccgtaccccgtaccccggtaaccccggtaacccggtaccccgtacccgttaccccgg

SEQ ID NO: 359487 - DNA, 632 bp, Homo sapiens
  misc_feature: GZ8MTXP02G10RG.17.33.C11.1.454.CMB.2.raw
  modified_base (301)..(301): a, c, t, g, unknown or other
  misc_feature (301)..(301): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtgccttccaacactggagcagtcaccagtgcttactataccaaactggttccagcaagaaacctggacaagccaccgaggcactctatttanagtaacaaacaacaaacactacctcgacccctgacccgtattcctacacggtcctcccccgtcgtggggacaagctacgcctgactactcgtcgtggtagtcgcgagccgtaggacggacggacgcgtagtacgttacttacgtcgtaccttacttacgttaccgtttgggtcggttgtccgttggtcgtcgttacggttcggggacgggacggtacgaacgtcgtacggtaccgttacgtaacgtacgaccggacccgaacggtccgcccggtccccgtaacggtccctaccgttccgttcccgttaccccctccccttaccgttacccg

SEQ ID NO: 359488 - DNA, 596 bp, Homo sapiens
  misc_feature: GZ8MTXP02H4NML.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctgacaagcaccaggcactcatttatagtaacaaacaacaaaacactacctacgacccctcgcccgattcctcacggcctcccctccgttcggggcaaacgctcgccctgactactcgtcgtgtgtcgcacgctggaggacgaggctacgtactattactcgtcctactcttacgtttggtggttgtcgtgtgtctagttcggacggacggaccgaagcgtcgtaccgttacgttaacgtctacggacccgtaacggccgtacccggcccccgttccgggtacctaccgttccgttccgttcccccgtccccttaccccgtttacccg

SEQ ID NO: 359489 - DNA, 552 bp, Homo sapiens
  misc_feature: GZ8MTXP02HODDL.17.33.C11.1.454.CMB.2.raw
  modified_base (398)..(398): a, c, t, g, unknown or other
  misc_feature (398)..(398): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaaacctgacaagcacccaggcactcatttatagtaacaaaacaacaaaacactaccctcggaccccctcgaccccgtattcctcaggcctcccccctccgttggggacaaagctcgccctgacactgtctggtgngcagcctgaggacgaggcctgacttattactgcctactcttacgtttggtgtgctgtgtctagtcggcggtaggaccgaagctagaccgtattaagtacacgacccgaagcctccgccccgtcggtcacgtcctcgtccccgcccttcctcccg

SEQ ID NO: 359490 - DNA, 549 bp, Homo sapiens
  misc_feature: GZ8MTXP02JLJOK.17.33.C11.1.454.CMB.2.raw
  modified_base (371)..(371): a, c, t, g, unknown or other
  misc_feature (371)..(371): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctagaagacaggctccaccatcaccaaggaccacctccaacaaaccgnggtacgtcttaacatgaaccaatatacggaccctggtcggacacgagcccacatattactgttcacgctctagtggtcgggtattacttagtccttagttacgactacgtcggggcctagggaacctcgtcggtcaccgtctccgcacgccctcaccgtaacggccctacgtccccgg

SEQ ID NO: 359491 - DNA, 560 bp, Homo sapiens
  misc_feature: GZ8MTXP02G7SR7.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtggggctggatccgtcacgccccaggaaaggccctggagtggcttgcgctcatttatggatgagagtaagcactacagtccgtctctagaaagaacaggctaccaccatacaaccaaaggaccaacctccaacaaaaccgaggtcgtaccttaacaaatacgaaccaataatcggaaccctgacgacacagccaacatattactgttacacgtctactagtgggttcgggattagttacgtccttattgactacgtcgggccagggtactcgtcggtccaccgtctaccgcacgccctaccgacaacgggccctagtcccgg

SEQ ID NO: 359492 - DNA, 693 bp, Homo sapiens
  misc_feature: GZ8MTXP02FXSZ8.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccgaggaaacggccctggagtggctgcgctctatttagtgggatgagagtaagcactacagtccgtctctagaagacgagctaccaccatacaaccaaggaccacctaccaaccaaaaccgacggttacgtaccttaacaaacgtacgaaactaaattacgtacggtaacccctggtacgggaaccacgaacgacccaactaacttactttaacctggttaccaccggtcttaccgttaaggttacggggttaccgggggttaatttaacgtttaccgtttacccccgttaagttttacggaaccgttacgggtaccggggggtaccctaaagggggtaacccttcgtacgggtaccctaaccggttcccgtacccggcacccggtccctaaccccgaacccggtaaaccggggccccctaacggtttcccccggg

SEQ ID NO: 359493 - DNA, 581 bp, Homo sapiens
  misc_feature: GZ8MTXP02JH6V9.17.33.C11.1.454.CMB.2.raw
  modified_base (352)..(352): a, c, t, g, unknown or other
  misc_feature (352)..(352): n is a, c, g, or t
  modified_base (407)..(407): a, c, t, g, unknown or other
  misc_feature (407)..(407): n is a, c, g, or t
  modified_base (424)..(424): a, c, t, g, unknown or other
  misc_feature (424)..(424): n is a, c, g, or t
tcagcgtagactagcacgaccggtgctcgatttagagtgagctcgttgggtttggggggcgccaggggtcccttccaatatcagcaccattgcctggactcctctctttctgttcctcctcacttgctgcccagggtccaattctcagactgtggtgactcaggagccctcactgactgtcgtccccaggaggacagtcactctcacctgtgcttccaacactggagcaagtcaccagtgcttaactactaccaaactggttaccagacaacgaacctaggaacaacgccaaccgaggccactcaatttatagaacaaacaaacaaacactccacggaccctgacccattcncacggtcctacccctcgtggggacaaagtctacgcctgactacgtgtcgtggtgngcacgcgagagacgagngtctactactactactactacttacttacgttggtgtgtgtgtgtcgtacgtacggacggacggacgaacgtacgtacgtacgtacgttacgtacgacgaccgacgtaccgtccgtcccgtccgtacctaccgtccgtccgtcccgtccctacctcg

SEQ ID NO: 359494 - DNA, 610 bp, Homo sapiens
  misc_feature: GZ8MTXP02F5TW3.17.33.C11.1.454.CMB.2.raw
  modified_base (299)..(299): a, c, t, g, unknown or other
  misc_feature (299)..(299): n is a, c, g, or t
  modified_base (344)..(344): a, c, t, g, unknown or other
  misc_feature (344)..(344): n is a, c, g, or t
  modified_base (387)..(387): a, c, t, g, unknown or other
  misc_feature (387)..(387): n is a, c, g, or t
  modified_base (397)..(397): a, c, t, g, unknown or other
  misc_feature (397)..(397): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccaacactggagcagtcaccagtgcttactataccaaactggttccagcaagaaacctggacaagcacccaggcactcatttanagtaacaaacaacaaacactcctacggaccccctgcccgattccncgacggtcctccccctccgttggggacaaagctcgccctgacnctgtctggtntgcagcctggagacgaggctagacttatactgtcctacttcttacgtttgggtcgtgtctggtcgtacgttagttccgggacgggtaacgggacctaaacgtcgtacggtacccgttacgttaaacggtaccgtacgacccgaacggtcctcccggtcccccgtcggtaccctaccgttccgttccgttcccccgtcccgttccctttacccg

SEQ ID NO: 359495 - DNA, 626 bp, Homo sapiens
  misc_feature: GZ8MTXP02HDZXL.17.33.C11.1.454.CMB.2.raw
  modified_base (320)..(320): a, c, t, g, unknown or other
  misc_feature (320)..(320): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcacagatcaccttgaaggagtctggtcctacgctggtgaaacccacacagaccctcacgctgacctgcaccttctctggcttctcactcagaacgagtggaatgggagtgggctggatccgtcacgccccaggaagccctggagtggcttgcgctctatttagtggatgagagtaagcactacagtccgtntctagaagaacaggcccctacaccatccaaccaaggaccaccctaccaaacaaaccgaggttacgtaccttaacaatacgaaccaaattactcggtaacccctgtacggaacacgaacgacccaactattaaattacttgttacacgtctacgttaagtcggggttacggggtatttaacgttacgtaccctttatttacgaacttacggcggggtaccgaacgggtaaaccttcgtacgggtaccctaaccgttccgtcccgacaacggtccccttaaccgaccgaaaccggggccctaacccgg

SEQ ID NO: 359496 - DNA, 678 bp, Homo sapiens
  misc_feature: GZ8MTXP02IF5J7.17.33.C11.1.454.CMB.2.raw
  modified_base (148)..(148): a, c, t, g, unknown or other
  misc_feature (148)..(148): n is a, c, g, or t
  modified_base (188)..(188): a, c, t, g, unknown or other
  misc_feature (188)..(188): n is a, c, g, or t
  modified_base (209)..(209): a, c, t, g, unknown or other
  misc_feature (209)..(209): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggngtctggtcctacgctggtagaaaacccacacagacccctnacgctgacctgccaccttctntgcttctcactcagaacgagtggaagtggggagtgggctggactccgtcacgccccgaggaacggccctggagtggcttgcgtctctatttagtggatgagtagtaagctactacgacgttccgtctacgtagaaacgaacacggcctaccgacctactaccaaaccgaaacggacccaaccctacccaaacgtaaaaccggtacgggttaccggttaacccttaacgaaactacggaaaccctaaagtacgtacgggaccctgggtaccgaacaaccgagtaccccaataacttaacttacgttacgtacctacgttcttacgttaggttcgggttacggggtaattttacgttacgttaccttacgtttgaccgttacggtcggggactaacgggtactcggtcggtaccgtaccgttctaccggctaccggccctaccgaaccgtaccggaccctacgttccccgg

SEQ ID NO: 359497 - DNA, 603 bp, Homo sapiens
  misc_feature: GZ8MTXP02GAMX0.17.33.C11.1.454.CMB.2.raw
  modified_base (293)..(293): a, c, t, g, unknown or other
  misc_feature (293)..(293): n is a, c, g, or t
  modified_base (335)..(335): a, c, t, g, unknown or other
  misc_feature (335)..(335): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacagcaccaggcactcatttanagtacaaacaacaaacactcctcggacccctgcccgtattcncacggcctcccccgtcgttggggacaaacgctcgccctgacactgtctggtgtgcagcctggaggacgaggcgtgacttatactcgtacctacttcttacgtttgggtggtgtcttggtgtacgttagttcgggacgggtaacgggaccaacggtcttacggtacccgttacttaaacggtccaacggacccgaaacgggcccgtcccgtcccccgttccggtaccctacttcccgttccgttccccctacccttcccctttaacccg

SEQ ID NO: 359498 - DNA, 557 bp, Homo sapiens
  misc_feature: GZ8MTXP02HIH9Z.17.33.C11.1.454.CMB.2.raw
  modified_base (296)..(296): a, c, t, g, unknown or other
  misc_feature (296)..(296): n is a, c, g, or t
  modified_base (342)..(342): a, c, t, g, unknown or other
  misc_feature (342)..(342): n is a, c, g, or t
  modified_base (389)..(390): a, c, t, g, unknown or other
  misc_feature (389)..(390): n is a, c, g, or t
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
  modified_base (436)..(436): a, c, t, g, unknown or other
  misc_feature (436)..(436): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccagggaggacagtcactctcacctgtgcttccaaacactggagcagtcaccagtgcttactatcaaactggtccagcagaaacctggaacaagcacccaggcactcattanagtaacaaaacaaacaaaacactcctaggacccctggacccattcncaggctccccctccgttggggacaaagctgcctgacactgctgggtnncagctgagacgagtntagatatcngtactactcttagttggtgtgntgatcgtacggtcggacggacgacagtcgtacgtacgtacgttacgacgacgaacccgtacgtccgtacccggccccgtaacgtacctaccgttcctacccttaccccaccctttcctacg

SEQ ID NO: 359499 - DNA, 597 bp, Homo sapiens
  misc_feature: GZ8MTXP02G4DXC.17.33.C11.1.454.CMB.2.raw
  modified_base (293)..(293): a, c, t, g, unknown or other
  misc_feature (293)..(293): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcacctgtgcttccaacactggagcagtcaccagtgcttactatccaaactggtcagcagaacctggacaagcaccgaggcactcatttanagtaacaaacaacaaacactcctacggacccctgacccgtattctcacggtcctcccccgtcgttggggacaaagctacgccctgacactgtctggtntgcagcctggagacgngctgtactacttactcgtacctacttacgttacgtttgggtggttgtcgttggtcgtcgttacggttcgggacgggaacgggaccgaagtcgtacgtaccgttacgttaacgccgacgacccgtaacggtccctcccggtccccgtcggtcctaccgttccgtcccgttcccctaccccttccttacccg

SEQ ID NO: 359500 - DNA, 628 bp, Homo sapiens
  misc_feature: GZ8MTXP02IVZHA.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaacggccctggagtggcttgcgctcatttatgggatgagagtaagcactacagtcccgtctctagaagacaggctccaccatcaccaacggaccacctccaacaaaccaggtcgtcctacaatcgaaccaatactacggaccctggtacgacacgagccacatacttactcgttcacgtctactagtcgggttcggggtatttacgttacgtcccttacgtttacgacgttacggttcgggggacccgtaagggggtaaaccttccggtacgggttacccgaaccccggttcccgttacccggccgtaccggtaccccttaccccgaacccgaaaccggggtccccctaacgtttcccccgggg

SEQ ID NO: 359501 - DNA, 559 bp, Homo sapiens
  misc_feature: GZ8MTXP02JYZCP.17.33.C11.1.454.CMB.2.raw
  modified_base (320)..(320): a, c, t, g, unknown or other
  misc_feature (320)..(320): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattatagtacaaacaacaaacactcncgaccctgcccgtatctcacgcctccctccgttggggcaaacgctcgccctgacactgtctggtgtgcgacgcctaggaggacgaggctgacttattacgtcgtcctactctacgtttggtggtgctgtgtctagttcggcgggacggtaccaagtccgtaggaccgtacgttaacgcacgacccgaacggccgtccgcccccgtcggtacctaccgtcctccgttcccccgtcccccg

SEQ ID NO: 359502 - DNA, 720 bp, Homo sapiens
  misc_feature: GZ8MTXP02GW7ZG.17.33.C11.1.454.CMB.2.raw
  modified_base (642)..(642): a, c, t, g, unknown or other
  misc_feature (642)..(642): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcctaccttctctggtccttctcactcaaggaacgaggtaggaagtggggagtgggctggactccgtcgacgccccgaggaacggccctggagtggcttgcgctctagtttgttgggatgagagtaacgcaactacgacgtcccgtactctagaaacgaacgacggctacccaaccactacaaccgaaacggaccaaccctaccaaccaaaacgtacgggttacgttacccttaagaactacgaaaccctaaataacgtcgacccgtaggtcgaacacacgacctaactattactttacggtcttacgtaaccgtcgttaccgtttagggtacggggtttaccgggggtaaagtttacgtttaaccggttcccctttaaggtttcgaaaccgttacgggttacgggggacctacgggggtaaactttcggtacgggttaacccncccggtccttcccggaaccgtaacccgtcccgtaccccgaaacccgtaacccgggggtccctaacgtttccccccggg

SEQ ID NO: 359503 - DNA, 557 bp, Homo sapiens
  misc_feature: GZ8MTXP02IWZG1.17.33.C11.1.454.CMB.2.raw
  modified_base (348)..(348): a, c, t, g, unknown or other
  misc_feature (348)..(348): n is a, c, g, or t
  modified_base (364)..(364): a, c, t, g, unknown or other
  misc_feature (364)..(364): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgtcagcccccaggaagccctggagtggcttgcgctcattattggatgagagtaagcactacagtccgtctctgaaagacagctccacatcacagacacncacaacagtgtcctanatgaaccatatcgacctgtgacacagaccacatattactgttacaacgtctacgtagtggttacgggtagttacgtttacggttcccttacgttttacgactaacgttcggggaccaaaggggtaactccgtcggttacccaccgtccgtccgaacacgccctccaacccgaacggcccctaacgttccccgg

SEQ ID NO: 359504 - DNA, 686 bp, Homo sapiens
  misc_feature: GZ8MTXP02JNIY6.17.33.C11.1.454.CMB.2.raw
  modified_base (212)..(212): a, c, t, g, unknown or other
  misc_feature (212)..(212): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgcttcncactcagaacgagtggaatgggagtgggctggactccgcacgccccgaggaaacggccctggagtggcttgcgtctctatttagtgggatggagagtaacgcaactacacgttcccgtctacgtagaaagacgacggctaccaaccactaccaaaccgaaacggaccaaccctaccaaaccgtaaaaccgtaggggttaccgtacccttaacgaaacttacgaaaccctaatacgtcgaaccctggtacgacacgacgacctactacttacttaacgtcgttaccacgtcttacgttacggtcggggtttacggtagtttacgttaccgttcctttacgtttacgtacgttacggtacggggtacctaacgggtaaccgttcggtaccggttcctaaacccggttccgtcccgtaacgtaacccggtccccgtacccgaaacccggacccgggtaccctaccggtttcccccgg

SEQ ID NO: 359505 - DNA, 583 bp, Homo sapiens
  misc_feature: GZ8MTXP02F84D0.17.33.C11.1.454.CMB.2.raw
  modified_base (374)..(374): a, c, t, g, unknown or other
  misc_feature (374)..(374): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcacgccccaggaacggccctggagtggcttgcgctctatttatgggatgagagtaagcactacagtccgtctcgtagaaagacaggctccaccatacaaccaagaccacctccaacaaaccnggtacgtaccttaacaatacgaaccaaatacgtacgggaccctagtaggacacgaacgaccacaattattactgttcaactctacttagttgggttacgggtagttagttacgttcctttacttagtacgttacggtcggggaccaggggtaacctcgtcggtccaccggtcctaccgctacgcctaccgaccacggccacgttccccg

SEQ ID NO: 359506 - DNA, 683 bp, Homo sapiens
  misc_feature: GZ8MTXP02JVEIK.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaacgcctggagtggctgcgctctatttatgggatgagagtaagcactacacgtccgtctctagaaacgaacgacggactcccaaccactaccaaaccgaaacggaacccaaccctacccaaaccaaaacccgacgggttaccgggttacccttaacaaacttacgaaaccctaaattacgtcggaaccccttggtacggaaccacgacgacccaactaacttactttaacttcgttacaccgtcttacgtaggttcggggttacgggtagtttacgttacgttaccctttagtttcgtacgtacggttcgggggaccctaagggggaaccttcggtacggttccgacccggtttccgtaccccggaacgaccgaccccgttacccgaacccggtaccggggtacccctacgtttcccccgg

SEQ ID NO: 359507 - DNA, 716 bp, Homo sapiens
  misc_feature: GZ8MTXP02FZL9Z.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtggggctgggatccgtcacgcccccgaggaaacgccctggagtggctgcgctcatttagtggatgagagtaagcactacgagtcccgtctcgtagaaagaacacggcctcccaaccataccaaccgaaacggaccaaccctccaaaccaaaacccgtaggtacggttaccttaaacgaaatacgaaacccaaagtacgtacgggaaccctggtacggaaccacaacgaccactaacttattaaccttgttaccaacggtcttacttaaggttacgggttacgggggttaacgttttactttacgggttacccctttaacgtttacgtaaccgttaacggtccgggggtacccgtaacgggggtaaaccctttacggttcgggttacccgtaaccccggttccgttaccccggaaccgtacccggtaccccttaccccgaaacccggtaacccggggaccccctaacggtttcccccggg

SEQ ID NO: 359508 - DNA, 663 bp, Homo sapiens
  misc_feature: GZ8MTXP02FQFRF.17.33.C11.1.454.CMB.2.raw
  modified_base (388)..(388): a, c, t, g, unknown or other
  misc_feature (388)..(388): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtcgaaacccacacagaccctcacgctgacctgccaccttctctggcttctcactcagaacgagtggaatgggagtgggctggactccgtcacgccccgaggaacggcctggagtggcttgcgctctatttagtgggatgagagtaagcactactacgtccgtctcgtagaaagaacaggctaccaccactacaaccaaggacccaacctcccaaacaaaccgnggtaccgtacccttaacgaacttacgaaaccctaaattaacgtacggaccccgttaggtacggaaccacgaacgacccaactaacttactttaacctcgttacctacggtcttacgttacggttggggttaccgggtagtttacgttacgttcccttacgttcgtaacgtacggtacggggacctaaggggtaacctcggttacgtccgtacccgtccgtccggaactaccggtaccctacccgaaccggaaccgggtccccacgtttccccggg

SEQ ID NO: 359509 - DNA, 650 bp, Homo sapiens
  misc_feature: GZ8MTXP02FVSEX.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgtcacgccccgaggaacggccctggagtggcttgcgctctatttagtgggatggagagtaagcactacagtccgtctcgtagaaagaacacggctacccaccataccaaccaaacggaccacctccaaacgaaaccgagggttacgtacccttaacgaactacgaaaccctaatacgtacggaacccttggtaacggacacgacgacccaacaattacttaactcgttacaccgtcttacttacggttgggttaccggggtatttacgttaccgttacccttagtttacgactacggttacggggacccgtaagggtaacctcgttacggtacccgtaccgttcctaccggccaccggtaccctacccgaaccgaccgggtacccctacggtttccccgg

SEQ ID NO: 359510 - DNA, 627 bp, Homo sapiens
  misc_feature: GZ8MTXP02H8D77.17.33.C11.1.454.CMB.2.raw
  modified_base (341)..(341): a, c, t, g, unknown or other
  misc_feature (341)..(341): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaacgcacccaggcactcatttatagtacaaacaaacaaaacactcctcgaccccctgccccgattcncaggcctccccctccgttggggacaaagctcgccctgacactgtctgggtgtcgcgacgcctgacggacgaggcgtagacgttattacctcgtacccttacttccgttacgttttgggtgggttcgtcgttggttggtctttaaggtccggggtacgggacggggtaaccaaggtctacggtaccgttcgttaaaggtcgtaacgacccgtaacgccgtcccgtcccccgtaaccggtcccgtaccgttccgtcccgttcccccggtccccttacccgtttccccg

SEQ ID NO: 359511 - DNA, 555 bp, Homo sapiens
  misc_feature: GZ8MTXP02IW5DC.17.33.C11.1.454.CMB.2.raw
  modified_base (317)..(317): a, c, t, g, unknown or other
  misc_feature (317)..(317): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccgaggaaacggccctggagtggcttgcgctcatttagtgggatgagagtaagcactacngtcccgtctctagaagacaggctccaccactcaccaagaccacctccacaaaccaggtcgtaccttacaatgaaccaatactacgaccctgtagacacgagtaccacatattactgttaccacgtctacgtagtggttcggggtatttagttacgtcccttatttcgactacgtcgggaccagggtaactgtacgtcaccgtctccgcacgtcctaccaccgaacggccctagtcccg

SEQ ID NO: 359512 - DNA, 570 bp, Homo sapiens
  misc_feature: GZ8MTXP02GHIB6.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaaggccctggagtggcttgcgctcatttattgggatgagataagcactacagtccgtctctagaagaacaggctccaccatcaccaaggaccacctccaacaaaccaggtcgtcctaacaatcgaaccaatactcggaccctgtggacacacgccaacattagttactgttacacgtctacgtagttcgggttcgggagtttactacggttcccttatttcgacgttacgtcggggacctagggtaacttcgtcggtcctaccgtcctccgctacgccctacccaaccgaacggccctagttccccgg

SEQ ID NO: 359513 - DNA, 608 bp, Homo sapiens
  misc_feature: GZ8MTXP02F9AKB.17.33.C11.1.454.CMB.2.raw
  modified_base (296)..(296): a, c, t, g, unknown or other
  misc_feature (296)..(296): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtcaccagtgcttactatccaaactggttccagcagaaacctggacaagcaccaggcactcatttanagtacaaacaacaaacactcctcggacccctgcccgattctcaggctcccctcgtggggcaaagctgccctgacactgtctggtgtgcagcctgagacgaggctagactattactgacctactcttactttggtggtgcgttgtgtacgttagtttccgggacgggtaacgggaccaaaggtcgtacggtaacccgttacgtttaaaacggtccaacggtaccccgaaacgggtccgttccggaccccccctcggggttaccctaaccgtttcccttccggtttcccccggtcccccttcccgtttaccccg

SEQ ID NO: 359514 - DNA, 670 bp, Homo sapiens
  misc_feature: GZ8MTXP02IO1RV.17.33.C11.1.454.CMB.2.raw
  modified_base (186)..(186): a, c, t, g, unknown or other
  misc_feature (186)..(186): n is a, c, g, or t
  modified_base (637)..(637): a, c, t, g, unknown or other
  misc_feature (637)..(637): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctnacgctgacctgcctaccttctctgcttctcactcagaacgagtggaagtgggagtgggctggactccgtcacgccccaggaacgcctggagtggctgcgctctagtttagtggggatggaagtaagtaacgactaacgtacgtcgttcccgtctacgtaggaaacgacgacggtcctaccccaccctactacccaaaccgaaacggaacccctaacccctacccgaaaccggtaaacccgtacgggttacccgttaacccttaaacaaacgtacgaaacctaatacggtacgtaccgtgtacgaacacgacaccaatactattacgtacgttacacgttcttacgttggttacgggtacggttagttacgtttaccgtaccttagtttcgacgtacgggtacgggaccgtaaggtaccttcggtccggttcctccgtacctccgcgacccnccgtacccgaccggacccggtcctacgtccccg

SEQ ID NO: 359515 - DNA, 661 bp, Homo sapiens
  misc_feature: GZ8MTXP02GS55Y.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagacccctcacgctgacctgcctaccttctctggcttctcactcagaacgagtggaagtgggagtgggactggactccggtcacgaccccgaggaacggccctggagtggcttgcgctctatttagtgggatgagagtaagcactatacgtccgtctactagaaacgacacggcctacccaccaactaccaaaccgaaacggacccaaccctacccaaacgaaaacccggtgggtaccgttaccttaacaaacgtacgtaaaccctaaagtacgtacggacccttaggacggaacaccgacgaccaactacttacttactcgttaccacggtcctacgttagggttacggggttacggggttaatttacgttacggttcccttagtttacgacgttacggtcggggacacgggtacctggtacgtccgtaccgtccgtaccaacgtcgtacccaccgaccgaaccggccctacgtttcccccg

SEQ ID NO: 359516 - DNA, 671 bp, Homo sapiens
  misc_feature: GZ8MTXP02J19L1.17.33.C11.1.454.CMB.2.raw
  modified_base (148)..(148): a, c, t, g, unknown or other
  misc_feature (148)..(148): n is a, c, g, or t
  modified_base (206)..(206): a, c, t, g, unknown or other
  misc_feature (206)..(206): n is a, c, g, or t
  modified_base (320)..(320): a, c, t, g, unknown or other
  misc_feature (320)..(320): n is a, c, g, or t
  modified_base (328)..(328): a, c, t, g, unknown or other
  misc_feature (328)..(328): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggngtctggtcctacgctggtcgaaacccacacagaccctcacgctgacctgccaccttcnctggcttctcactcagaacgagtggaatgggagtgggctggactccgtcacgccccgaggaacggccctggagtggcttgcgtctctatttgtgggatgagagtaagcactacncgtccgtntcgtagaaagacgaggcctacccaccatacccaaccgaaacggacccaaccctacccaaaccgtaaaacccggtacgggttaccgttaaccctttaaacaaacgttaccgaaaccctaaagtacgtaccgggtacccttaggtacggaacaccgactacccaatacttaacgttacttcgtaccacgtcttacgttaggttggggtttacggtagtttacgttacgttacccttacgtttacgacgttcggtacggggacgtaaggaccgttcgtcggtaccctaccggttcctaccgcgtaccgtacccacccgaaccggtaccggccctacgtttccccgg

SEQ ID NO: 359517 - DNA, 572 bp, Homo sapiens
  misc_feature: GZ8MTXP02FG9DC.17.33.C11.1.454.CMB.2.raw
  modified_base (300)..(300): a, c, t, g, unknown or other
  misc_feature (300)..(300): n is a, c, g, or t
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
  modified_base (417)..(417): a, c, t, g, unknown or other
  misc_feature (417)..(417): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcagggagccctcactgactgtcgtccccaggagggacagtcactctcacctgtgccttccaacactggagcagtcaccagtgcttactatccaaactggttccagcagaaacctggacaagcacccagggcactcatttanagtacaaacaacaacactcctgacccctgccgattcncacggcnccccctccgttggggcaaagctgccctgacactgtctgtgtgcacgcctgagggacgaggctgactagttacncgtcctacttctacgtttggtggtgtcttgtgcttagttcgggcggacggggaccaaagcgtagacccgtacttaaacgtcgacgaccctaaacggcctccgccccccttcgggtccctacctccgtccgtttacccccgccccttcccttcccg

SEQ ID NO: 359518 - DNA, 584 bp, Homo sapiens
  misc_feature: GZ8MTXP02IG5M2.17.33.C11.1.454.CMB.2.raw
  modified_base (175)..(175): a, c, t, g, unknown or other
  misc_feature (175)..(175): n is a, c, g, or t
  modified_base (185)..(185): a, c, t, g, unknown or other
  misc_feature (185)..(185): n is a, c, g, or t
  modified_base (213)..(213): a, c, t, g, unknown or other
  misc_feature (213)..(213): n is a, c, g, or t
tcagcgtagactagcacgaccggtgctcgatttagagtgagctcgttgggtttgggagactcctgtgccccaccatggacacactttgctccacgctcctgctgctgaccatcccttcatgggtcttgtcccagatcaccttgaaggagtctggtcctacgctggtgaaacccanacagaccctnacgctgacctgcaccttctctggcttcncactcagaacgagtggaatgggagtgggctgggatccgtcacgccccaggaaggccctggagtggcttgcgctcatttagtggatgagagtaagcactacagtccgtctctagaagaacaggcctaccaccactccaaccgaaacggaccacccgtacccaaacaaaccgacgggttcggtaccttaacaaactacgaaaccaattaagtacggaccctagtacggacacacgccaacatacttactgttcacgtctactagtggttacgggtattagttacgttccttacgtttacgactacgtacggggactacgggtaactcgtacggcctaccgtctccgcacgcctaccaccgaacggccctaccg

SEQ ID NO: 359519 - DNA, 703 bp, Homo sapiens
  misc_feature: GZ8MTXP02GD1R7.17.33.C11.1.454.CMB.2.raw
tcagcgtagactagcacgaccggtgctcgatttagagtgagctcgttggggtttgggggactcctgtgccccaccatggacacactttgctccacgctcctgctgctgaccatcccttcatgggtcttgtcccagatcaccttgaaggagtctggtcctacgctgatgaaacccacacagaccctcacgctgacctgcaccttctctggcttctcactcaagaacgagtggaatggggagtgggctggactccgtcacgccccgaggaacgccgtggagtggcttgcgctctatttagtggatgagagtagcactacagtcctctctagaagaacacggcctaccaccactaccaaccgaaacggaccaccctaccaaaccgaaaaccgtaggtacgtaccttaaacaaattacgaaacctaaattagtaccgggtaacccttagggtacggaaccaacgaaaccgacccaaaactaacgtttaaactttaacccttaggtttacccaccgtacttacgttaaacgggttccggggtttaggggtaacggttttactttaaccggttaccctttaacgttttacgaccgttacgggtacgggggtaccgaacgggttaaccttcggtacgggtaaccctcccggttccgtcccggaccaaccggtcccctaccgaacccggaaccggggtccccttaaccggg

SEQ ID NO: 359520 - DNA, 631 bp, Homo sapiens
  misc_feature: GZ8MTXP02G1I48.17.33.C11.1.454.CMB.2.raw
  modified_base (331)..(331): a, c, t, g, unknown or other
  misc_feature (331)..(331): n is a, c, g, or t
  modified_base (434)..(434): a, c, t, g, unknown or other
  misc_feature (434)..(434): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtcgaaacccacacagaccctcacgctgacctgccaccttctctggcttctcactcagaacgagtggaatgggagtgggctggactccgtcacgaccccgaggaaacgcccgtggagtggcttgcgctctattagttggatgagagtacgcactacacgtccgtctntagaagacaggctccaccatacaaccgaagaccactaccacaaacgtcggtacgtaccttaacatacgaacataacgtcgaacccttgacgacacagacctanacttaattactgttaccacgtcttacttaggtcgggttacggggtaatttacgttaccgttccgttatttacggtaaccgttcgggttacgggggacccgtaaaggggttaccttacggtaccgggttcgtaaccccgttcgtacccgaactaccggacccctacgaaccgtaacccgggcctaacggtttcccccg

SEQ ID NO: 359521 - DNA, 607 bp, Homo sapiens
  misc_feature: GZ8MTXP02HZWBC.17.33.C11.1.454.CMB.2.raw
  modified_base (227)..(227): a, c, t, g, unknown or other
  misc_feature (227)..(227): n is a, c, g, or t
  modified_base (268)..(268): a, c, t, g, unknown or other
  misc_feature (268)..(268): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggaggacagtcactctcacctgtgcttccaacactggancagtcaccagtgcttactataccaaactgtccagcagaacngacagccaccgaggcatcatttatagtaacaaacaacaaaacacctctacgaccctcgccgtactccacacggccttacccccgtcgttacggggacaaacgctcgccctgacctactgtcgtgtgtcgcacgcctgacggacgaggctagtactattacgcgtccttactcgttacgttggttacggtgtcgtgtcgtgttcggttacgggacgggtacgggaaccgagtccgtacggtacccgttagttaacgaccgacggtacccgaacggtccgtacccggacccccgtcggtacctaccgtccgttccgttaccccctaccctttacccctccg

SEQ ID NO: 359522 - DNA, 636 bp, Homo sapiens
  misc_feature: GZ8MTXP02FR4NH.17.33.C11.1.454.CMB.2.raw
  modified_base (353)..(353): a, c, t, g, unknown or other
  misc_feature (353)..(353): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtcttgtcctacgctggtacgaaacccacacacgaccctcacgctgacctgccaccttctctggcttctcactcaagaacgagtggaagtggggagtgggctggactccgtcacgccccgaggaacggccctggagtggcttgcgctctatttagtggatgagagtagcactacagtccgtctcgtagaaagacagctccaccanacaacgaagaccacctccaacaaaccgtaggtcgtaccttaacactacgaacctaatacgtcggaaccctggacgacacacgaccaatattacttactcgttacacgtcttacgtagttgggttacgggtatttacgttacgttacccttagtttcgacgttacggtcggggtaccgtaaggtaccttcggttaccggtaccgtacccgtccgttacccgaacgtacccgtaccccgtaccccgaacccggtaaaccggtaccccgtacggtttccccccggg

SEQ ID NO: 359523 - DNA, 550 bp, Homo sapiens
  misc_feature: GZ8MTXP02GJJQJ.17.33.C11.1.454.CMB.2.raw
  modified_base (372)..(372): a, c, t, g, unknown or other
  misc_feature (372)..(372): n is a, c, g, or t
  modified_base (448)..(448): a, c, t, g, unknown or other
  misc_feature (448)..(448): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtggggctgggatccgtcagcccccaggaaagccctggagtggcttgcgctcatttatgggatgagagtagcactacagtccgtctctgaaagaacaggctaccaccatcaaccaaggaccacctccacaaaccnggtacgtaccttacaaatcgaaccaaatacgtcggaccctgtcggacacacgcaacacttatacctgttacacgtntctagttgggttcgggtatttattacgttccttactttgactaacgtcgggccagggactcgtcggtcaccgtctcgcacgcctcaccacggcccagtcccg

SEQ ID NO: 359524 - DNA, 607 bp, Homo sapiens
  misc_feature: GZ8MTXP02GQZVI.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtaccagcaagaaacctggacaagcaccgaggcactctatttataagtaacaaacaacaaaacactccgtacggaccccctgacccgtattctcgacgtcctcccccgtcgtggggacaacgctcgcctgacactgtcgtggtgtgcagccgtaggacggacgaggctagacttattacgtcgtaccttacttacgttacgtttgggtggttgtcgttggtacgtcgttaggttcgggacggaacgggtaccaagtcgtacgtaccgttacgttaacggtacgacggaccgaacggccgtccgtccccgtcggtacctacgttccttccgtaccccctaccctccctttaccg

SEQ ID NO: 359525 - DNA, 572 bp, Homo sapiens
  misc_feature: GZ8MTXP02JQ7P0.17.33.C11.1.454.CMB.2.raw
  modified_base (527)..(527): a, c, t, g, unknown or other
  misc_feature (527)..(527): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgtcagcccccaggaaaggccctggagtgcttgcgctcatttagtgggatgagagtaagcactacagtccgtctctagaagaacaggctaccaccataccaccaaggaccacctccaacctaaacgaggtcgtacctacaatcgaaccaatagcgaccctgtacgacacacgccaacattaacttactgttcacgtctactagttcggtcggggtatttagttacgtccttacgttgactacggtcgggaccgaggacttcgtacggtaccaccgtcnccggtaacacggtccctacgaccgaccggaccctacgttccccgg

SEQ ID NO: 359526 - DNA, 567 bp, Homo sapiens
  misc_feature: GZ8MTXP02F16MG.17.33.C11.1.454.CMB.2.raw
  modified_base (319)..(319): a, c, t, g, unknown or other
  misc_feature (319)..(319): n is a, c, g, or t
  modified_base (427)..(427): a, c, t, g, unknown or other
  misc_feature (427)..(427): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaagccctggagtggcttgcgctcatttatgggatgagagtaagcactacagtccgtntctagaaagaacaggctaccaccatacaaccaaggaccacctccaacaaaccgaggtcgtaccttaacaatcgaaccaaatactacggaacccttggagaacacgacnccaacatagttaacctgttacacgtctctagtgggttacgggattattacgtaccttagttgtacgtacgtcgggccaagggtactcgtcggtctaccgtctccgcgtcgaccctaccgacgaacggcccagttccccgg

SEQ ID NO: 359527 - DNA, 696 bp, Homo sapiens
  misc_feature: GZ8MTXP02G9XMZ.17.33.C11.1.454.CMB.2.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatcaactggtccagcagaacctggacagcacccaggcactcatttatagtacaaacaacaaaacactcctacggacccctgccccgattctcaggcctccccccgtccgttggggacaaaggccttcggccctgacctactcgtctgggtgtcgcgtacgccgtggaacgggacggacggacgttagaccttaacgttaccgtacggtacccttacgttaccttaccgttttgggtcggttgtccgttggttcgtacgttaacggttcgggaccgggtacggggaacccgtaaagtccgtacggtaacccggttacgtttaacggttaccgtaaaccggcccccgaaacggtcccgttacccggtacccccccgttaaccgggttccccgtaaacctttccccgttacccgggtttcccccccgtacccccgtttccccctttaacccccgg

SEQ ID NO: 359528 - DNA, 559 bp, Homo sapiens
  misc_feature: GZ8MTXP02IWPYP.17.33.C11.1.454.CMB.2.raw
  modified_base (226)..(226): a, c, t, g, unknown or other
  misc_feature (226)..(226): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (386)..(386): a, c, t, g, unknown or other
  misc_feature (386)..(386): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggaggacagtcactctcacctgtgcttccaacactggancagtcaccagtgcttacatccaaactggtccagcagaacctggacagcaccaggcactnatttanagtaacaaacaacaaaacnctacctcggaacccctgcccgattctcaggcctcccctccgtggggacaagctcgccctgaccactgtctggtgtncacgcctcgaggacgaggctagactatctgcctactcttagttcggtgtgtctgtgtctagttcggaggacggaccaagtcgtacgtaccgtgttaaacgccaacggccctaacggccctcggccccccgtggtacccacgttcctaccgttccccacccttcctttaacccg

SEQ ID NO: 359529 - DNA, 626 bp, Homo sapiens
  misc_feature: GZ8MTXP02F5MCK.17.33.C11.1.454.CMB.2.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttccaacactggagcagtcaccagtgcttactatccaaactggttaccagcaagaacctggacaagcaccaggcactcattatagtacaaacaacaaacactccacggacccctgacccgattcctacacggtcctacccccgtccgttacgggggacaaacgtctacgcccctggaccacgtcgtacctgggtgtgcagcctgaggacgagctagactattaacgtgacctacttcttacgtttgggtggtgcttggtgcgttagttcgggcgggtaacgggaccgaagtcgtacgtaccgttacgttaaacggtccgtaacgacccgaaacggtcctccccggtacccccgtaacgggtaccctaccgtaccttcccggttaccccctaccccgttccctttaccccgg

SEQ ID NO: 359530 - DNA, 593 bp, Homo sapiens
  misc_feature: GZ8MTXP02J1D4K.17.33.C11.1.454.CMB.2.raw
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcagaaacctggacaagcacccaggcactnatttanagtacaaacaacaaaacactcctcggacccctgcccgatcctcaggcctccccctccgttggggcaaacgctcgccctgacacgtgtctggtgtgcagcccgtggaggacggaggctgactattactgtcctactcttacgtttggtggtgtcgtgtgtctagttcggacgggtacgggaccaaggctacgtacccgtacttaacggtctaaacgccccgtaaacggccgtacccgcccccgttcgggtaccctaccttccgttccgtttcccccggtccccttcccgtttccccg

SEQ ID NO: 359531 - DNA, 698 bp, Homo sapiens
  misc_feature: GZ8MTXP02G5F2Q.17.33.C11.1.454.CMB.2.raw
  modified_base (215)..(215): a, c, t, g, unknown or other
  misc_feature (215)..(215): n is a, c, g, or t
  modified_base (281)..(281): a, c, t, g, unknown or other
  misc_feature (281)..(281): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtcgaaacccacacacgaccctcacgctgacctgccaccttctctgcttcncactcagaacgagtaggaagtggggagtgggctggactccggtcacgaccccgaggaaacggccgnggagtggcttgcgctctatttagtgggatggtaagagtaagctactacgtacgtcccgtctacgtacgaaagtacaacggtcacccaaccactaccaaaccgtaaacgacccaacctacccaaactaaaccgagggttaccgtaccttaacgaattaccgaaacctaagtaaccgtccgtacccgtggtacgaacaccgaacgaccctactattaacttacttcgttacctacgtacttcgttaaggttccgggggtttaacgggttaagtttacgtttaccttacccggttaacttttacggaacgttaacgggtcgggggtaccctaaagggggtaacccttgttaccgggccctacggttccacccggcaccgtacccgtacgacccggaaaccggtccctacgtttcccccgg

SEQ ID NO: 359532 - DNA, 587 bp, Homo sapiens
  misc_feature: GZ8MTXP02I2ULW.17.33.C11.1.454.CMB.2.raw
  modified_base (323)..(323): a, c, t, g, unknown or other
  misc_feature (323)..(323): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
  modified_base (422)..(422): a, c, t, g, unknown or other
  misc_feature (422)..(422): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatcgtcagccccaggaaacggcctggagtggcttgcgctctatttagtgggatgagagtaagcactacagtccgtctntagaagacaggctcccaccatacacagaccacctccacaaaccngtacgtaccttagaatgaaccaatacncggtaccctgtggaacaccgagaccaanacttattaactcgttcacgtcttactagttcggggttcgggaagttttagttacggttaccccttagttttacgacgttaacgttcgggggccgaaagggtactacgtcgggtacctacccggtctaccggcacgtcctaccacgaacggcccacgtttccccgg

SEQ ID NO: 359533 - DNA, 591 bp, Homo sapiens
  misc_feature: GZ8MTXP02IARH7.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaacggccctggagtggcttgcgctcatttatgggatgagagtaagcactacagtccgtctctgaagaacaggctcaccatcaacaaggaccacctccaacaaaccaggtcgtaccttaacgaactacgaacccaatactacggacccgtgtacggacacagaccaacattaacttactagttacacgtctactagttgggttacggggtagtttacgtttacgttcccttacgtttcgtacgtacgttacgggggaccaggggtaacctcgttcggtccgaccgtctccaacgacgcctaccaccgaacgggtcccacgttccccgg

SEQ ID NO: 359534 - DNA, 650 bp, Homo sapiens
  misc_feature: GZ8MTXP02FHP5E.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctgggatccgtcacgcccccaggaaacggccctggagtggcttgcgctcatttatgggatgagagtaagcactacagtccgtctcgtagaagaacaggactccaacactacaaccaacggaccacctccaaaccaaaccagggtcgtaccttaacaaatcgaaccaatagtcggaaccctgtacggacacacgacccacatactttaacgtcgttacaccgtcttcgttaacgttggggtttccgggggtagtttaacttacggttaccccttaacgttttacgacgttaaccggtcgggggacccgtaacgggggtaaaccttcgttacgggtacccgtacccggtccgttaccccgcgtacgtccccgtacccaacccggaaaccggggacccctacggttccccgg

SEQ ID NO: 359535 - DNA, 631 bp, Homo sapiens
  misc_feature: GZ8MTXP02IS676.17.33.C11.1.454.CMB.2.raw
  modified_base (312)..(312): a, c, t, g, unknown or other
  misc_feature (312)..(312): n is a, c, g, or t
  modified_base (395)..(395): a, c, t, g, unknown or other
  misc_feature (395)..(395): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacacgaccctcacgctgacctgcaccttctctggcttctcactcagaacgagtggaatgggagtcgggctggactacgcgacgcccaggaacgcctggacgtgctagcgctcagttatggatgagagtagcactacngtccgtctcgtaggaagacgagctaccacactcaaaccaaggaccacccaccgaaccaaaccgtaacggtcgttaccctaaanaactacgaaacctaatacgtacgtaccgtaggtacgacaacgacgaccctaactaacttaactttacgtcgtaccacgtcttacgttacgggttacggggttacgggttactttaacgttaccgttacctttacgtttacgtacgtacgggtacgggaccgtaggtaacctcgttcgtacctaccgttccgaccgcgtacccgcccgtacccgaccggacccggtcctacgtcccg

SEQ ID NO: 359536 - DNA, 533 bp, Homo sapiens
  misc_feature: GZ8MTXP02FE6SJ.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggcccctggagtggcttgcgctcatttatgggatgagagtaagcactacagtccgtctctgaagaacaggctccaccatcaccaaggacactccacaaaccagtgtccttacaaatgaaccaatatgaccctgtggacacagccacatattactgtcacgctctatggttcgggagttacttagtccctaacttgactacgtcggggccaggggaaactcgtcggtcaccgtctccgcagccctccaccgaaacgggcccattcccgg

SEQ ID NO: 359537 - DNA, 559 bp, Homo sapiens
  misc_feature: GZ8MTXP02HNM4J.17.33.C11.1.454.CMB.2.raw
  modified_base (409)..(409): a, c, t, g, unknown or other
  misc_feature (409)..(409): n is a, c, g, or t
  modified_base (517)..(517): a, c, t, g, unknown or other
  misc_feature (517)..(517): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccgtcagccccaggaagccctggagtggcttgcgctcatttatgggatgagagtaagcactacagtccgtctctgaaagacaggctccaccatcaccagaccactccaacaaacagtcgtacctacaatcgaaccaatactgaccctgtgacacagcccanatattactgttcacgtctctagtggttacggggtattagttacgtcccgttagtttcgaacttacgtcggggaccctaggggtaacctcgtacgggtccaccggttcncccggctacgccctccaccgacgggaccctacgtttccccgg

SEQ ID NO: 359538 - DNA, 647 bp, Homo sapiens
  misc_feature: GZ8MTXP02I5PH1.17.33.C11.1.454.CMB.2.raw
  modified_base (228)..(228): a, c, t, g, unknown or other
  misc_feature (228)..(228): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
  modified_base (389)..(389): a, c, t, g, unknown or other
  misc_feature (389)..(389): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttccaacactggancagtcaccagtgcttacatccaaactggttccagcaagaactgacagcaccgaggcactnatttanagtaacaaacaacaaacnctccacggacccctgcccgattcctcacgcctcccctcgttggggcaaacgctacgccctgactactgtcgtgggtntcgcagtccgtgtagggacgaggcgttagacttacgttacgtcgtccttacttacgtttaccgtttgggcggtttgtcgttggttacgtacgttacggttacggaccgggtaaggacccgtaagccgtacggtaaccggttacgtttacggaccgtaacgtacccggtaaacggtcccgtcccggttcccccgttaaccgggtccctaaccggttcccgttaccgttccccccgttaccgttaccccgtttaccccgg

SEQ ID NO: 359539 - DNA, 660 bp, Homo sapiens
  misc_feature: GZ8MTXP02HD24E.17.33.C11.1.454.CMB.2.raw
  modified_base (186)..(186): a, c, t, g, unknown or other
  misc_feature (186)..(186): n is a, c, g, or t
  modified_base (325)..(325): a, c, t, g, unknown or other
  misc_feature (325)..(325): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagaccctnacgctgacctgccaccttctctggcttctcactcagaacgagtaggaagtgggagtgggctggactccgtcacgccccgaggaaacggccctggagtggcttgcgtctctatttagtggatgagtagtaagcactacgngtcctctctagaaagacacggtctcccaccactaccaaccgaacggacccacctacccaaaccgtaaaccgtacgggttaccgtacccttaaacgaactaccgtaaaccctaaattaactccgggaaccccgttggacggaccaacgacgaaccctataactacttaactcggttacaccggtcttaccttaagggttgggttaccgggtagtttacgttccgttacctttagtttacgactacggtcgggtaccgaggtactcgtcgtaccgcccggttactcccgaacgacgtacccgacccgaccggtaaccggcccgtaacgtttccccgg

SEQ ID NO: 359540 - DNA, 560 bp, Homo sapiens
  misc_feature: GZ8MTXP02F549A.17.33.C11.1.454.CMB.2.raw
  modified_base (321)..(321): a, c, t, g, unknown or other
  misc_feature (321)..(321): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtcgaaacccacacagaccctcacgctgacctgcaccttctctggcttctcactcagaacgagtggaatgggagtgggctggatccgcacgccccaggaagccctggacgtggcttgcgctcatttagtgggatgagagtaagcactacagtccgtntctgaaagacaggctaccaccatacaccaagaccactccacaaacacgcgtacgtacaatacgactaacatacgaccgacgtggacacacgaccacatacttaactcgtactacgtacgtcctagtggttacgggtagttaagttacgtaccgttacttacgtacgtactcggggtccgaggtacgtactcggtacaccgtcctccgcacgccgtaccaccgacggaccctacgtcccg

SEQ ID NO: 359541 - DNA, 593 bp, Homo sapiens
  misc_feature: GZ8MTXP02IOVSS.17.33.C11.1.454.CMB.2.raw
  modified_base (219)..(219): a, c, t, g, unknown or other
  misc_feature (219)..(219): n is a, c, g, or t
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
  modified_base (335)..(335): a, c, t, g, unknown or other
  misc_feature (335)..(335): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtcccaggaggacagtcactctcacctgtgcttccaacnctggagcagtcaccagtgcttacatccaaactggttccagcaagaacctggacagcaccgaggcactcatttanagtaacaaacaacaaacnctccacgacccctgcccgattccncacggtctacccccgtcgtgggacaagctcgcctgactactgtcctgggtatcgcacgctggacgcgtagctagactagttactcgcctacttcgttacgtttgggcgtgtcgtgtcgtaccgttgttaccggggcggaacggaccaacggtctacgtacccggttattaaacgcgtaaccggacccgaagggtccctcggtcccccgtcggttccgcctttcccggtccgttacccccgtaccttcccttaacccgg

SEQ ID NO: 359542 - DNA, 668 bp, Homo sapiens
  misc_feature: GZ8MTXP02F4GKQ.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcacgccccaggaaagccctggagtggcttgcgctcatttagtgggatgagagtaagcactacacgtccgtctctagaaacgaacaggcctaccaaccatacaaccaaacggaccacctccaaacaaaccgtagggtacgtacccttaaacaaacttacgaaacctaaagttacgtacgggaacccttaggtacgggaaccaacgacgacccaactaactactttactcgttacaacgtcttacgttagttcggggttacgggtaagtttactttacggtaccctttagtttacgaaccgttacggtcgggggaccctaaaggggtaaccttccgttacgggtacctaacccgttccgttacccgccgacgtacccctacccgaacccggaaccgggcccctaacggtttcccccgg

SEQ ID NO: 359543 - DNA, 574 bp, Homo sapiens
  misc_feature: GZ8MTXP02HQDSQ.17.33.C11.1.454.CMB.2.raw
  modified_base (379)..(379): a, c, t, g, unknown or other
  misc_feature (379)..(379): n is a, c, g, or t
  modified_base (397)..(397): a, c, t, g, unknown or other
  misc_feature (397)..(397): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccaacactggagcagtcaccagtgcttactataccaaactggttccagcagaaacctggacaagcaccagggcactcatttatagtaacaaacaacaaaacactcctacggacccctgccgtattctcacggcctccccctccgttggggacaaagctcgccncgacactgtcctggtgtncacgcctgaggacgaggctgtactacttactcgtctactcgttacgtttggtggttgtcgtcgtgtcgtagttcgggcggacgggtacacgtctcgtaccgttatacgtcgacggacccgacggtcctccgcccccgttaacggtcacgttcctccgttccccacccttccttcccg

SEQ ID NO: 359544 - DNA, 591 bp, Homo sapiens
  misc_feature: GZ8MTXP02FR5KU.17.33.C11.1.454.CMB.2.raw
  modified_base (148)..(148): a, c, t, g, unknown or other
  misc_feature (148)..(148): n is a, c, g, or t
  modified_base (185)..(185): a, c, t, g, unknown or other
  misc_feature (185)..(185): n is a, c, g, or t
  modified_base (399)..(399): a, c, t, g, unknown or other
  misc_feature (399)..(399): n is a, c, g, or t
  modified_base (562)..(562): a, c, t, g, unknown or other
  misc_feature (562)..(562): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggngtctggtcctacgctggtgaaacccacacagaccctnacgctgacctgccaccttctctggcttctcactcaagaacgagtggaatgggagtgggctggactccgcacgccccgaggaacgcctggagtggcttgcgctctatttagtggatgagagtagcactacacgtccgtctctagaaagaacaggcctccaaccatacaaccgaacgacccaacctccgaaacaaaccgaggttacgtaccttaanaactacgaacctaatacgtcgaccttgagaccacacgaccatatacttactcgtacacgtactcgttagtaggttacggggtatttacgttacgttcccttacttagtacgtacggtcggggtacgtaagggtacctcgtcggtcacccggtctccgcgaccncccgtaccgaccgaccggcctacgtcccg

SEQ ID NO: 359545 - DNA, 673 bp, Homo sapiens
  misc_feature: GZ8MTXP02JG1VQ.17.33.C11.1.454.CMB.2.raw
  modified_base (282)..(282): a, c, t, g, unknown or other
  misc_feature (282)..(282): n is a, c, g, or t
  modified_base (308)..(308): a, c, t, g, unknown or other
  misc_feature (308)..(308): n is a, c, g, or t
  modified_base (323)..(323): a, c, t, g, unknown or other
  misc_feature (323)..(323): n is a, c, g, or t
  modified_base (338)..(338): a, c, t, g, unknown or other
  misc_feature (338)..(338): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaaaccccacacagacccctcacgctgacctgccaccttctctggcttctcactcaagaacgagtaggaatggggaggtgggctggactccgtcacgccccgaggaacggccnggagtgctgcgctctatttgtgggangagagaagcactacngtccgtctctagaanaacgagcacaccatacaacagaccacctccaaaccaaacgtggtacgtacctaacaaacgtacgaaacctaatacgtacggaaccctggtaccgaacacgacgacccaactaattaacgtttactcgtttaccaaccgttcttacgttacgggtttacggggttacgggttaagtttaacgtttaccggtacccctttagtttacgtaacgttacggttcgggggaaccgtaacggggttaacccgttcggtaccggttccgtaacccggtccgtcccgaaccgtaccgtccccgtaacccaaccggaacccggtaccctaacggtttcccccgg

SEQ ID NO: 359546 - DNA, 605 bp, Homo sapiens
  misc_feature: GZ8MTXP02G6PDD.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtggggagtgggctggactccgcacgaccccgaggaacgcctggagtggcttgcgctctagttagtgggatggagagtaagcactacgacgtccgtctcgtagaaagaacaggctaccaccactacaaccgaacgaccacctccaaaccaaacgtaggtacgttacctaacaatacgaaccaatactacggacctgtacgacacacgccaatactacttaactgtaccacgtcttagtacggttgggttacgggtatttacttaccgtaccttagtttcgacgttacggtggggaccagggtaccttgtccggtacacccgtcgtaccgcgtacggcccctaccgaaccgaccgggtaccctacgttcccccgg

SEQ ID NO: 359547 - DNA, 561 bp, Homo sapiens
  misc_feature: GZ8MTXP02JRO3L.17.33.C11.1.454.CMB.2.raw
  modified_base (228)..(228): a, c, t, g, unknown or other
  misc_feature (228)..(228): n is a, c, g, or t
  modified_base (296)..(296): a, c, t, g, unknown or other
  misc_feature (296)..(296): n is a, c, g, or t
tcagcgtagactagcacgaccggtgctcgatttagagtgagctcgttgggtttggggggcgccaggggtcccttccaatatcagcaccatggcctggactccctctctttctgttcctcctcacttgctgcccagggtccaattctcagactgtggtgactcaggagccctcactgactgtgtccccaggaggggcagtcactctcacctgtgcttccaacactggancagtcaccagtgcttacatccaaactggttccagcagaaacctggacaagcaccaggcactcatttanagtacaaacaacaaacactcctcggacccctgcccgattctcacggcctccccctcgttggggctaaacgctacgcctgacactgtctggtgtgcagccgtggacggacgaggctagactattactcgcctactcttacgttggtggtgctgtgcgttagttcgggcggtaggaccagcgtggtaccgtacttagtcacgcccgaacggcctccggcccccgtcggtcctacgttccttccgttccccctaccctcccttacccg

SEQ ID NO: 359548 - DNA, 710 bp, Homo sapiens
  misc_feature: GZ8MTXP02F16MN.17.33.C11.1.454.CMB.2.raw
  modified_base (213)..(213): a, c, t, g, unknown or other
  misc_feature (213)..(213): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttcncactcagaacgagtggaatgggagtgggctggatccgtcacgccccaggaacgccctggagtggcttgcgctctatttagtgggatggagagtaagcactacagtcccgtctcgtagaaacgaacaggctaccaccactacaaccgaaaggaccaacctccaacaaaaccgaggtcgtaccttaacaaatcgaaaccaatacgtcgaccctgtacggaacacaagacccaactaatactttaacctcggttactaaccgtcttacgtttaacggttggggtttaccgggggtaattttaacgtttaacgggtttaccccctttaagtttttacggaacccgtttaaacgggtttcggggggaacccgttaaacgggggtaaaaccctttaccggtcggggttacccgtaaccccggttccgttccccggaacgaacccggtaccccgttaccccgaaacccggtaaaaccggggccccctaacggtttccccccggg

SEQ ID NO: 359549 - DNA, 654 bp, Homo sapiens
  misc_feature: GZ8MTXP02FSS4F.17.33.C11.1.454.CMB.2.raw
  modified_base (311)..(311): a, c, t, g, unknown or other
  misc_feature (311)..(311): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccgaggaacgcctggagtggctgcgctctattagtggatgagagtagcactacncgtccgtctgtagaagaacacggctccaccatacaaccgaaggaccacctccaacaaaccgtaggtacgtaccttaacaaactacgaaacctaaagttacgtacggtaccctaggtacgaaccaacgtacgacccaacaaatttactttaaccgtcgttaccgaaccgtcttaccgttaaggttggggtttaccggggtatttacgtttaaccggttccctttacgttacgaccgtttaacggtcgggggtaacccgtaggggtaaaccttcggtacgggttaccacccggttcgtacccgctaccggccctaccgaaccgaacgggccctagtttcccccgg

SEQ ID NO: 359550 - DNA, 615 bp, Homo sapiens
  misc_feature: GZ8MTXP02JC9HB.17.33.C11.1.454.CMB.2.raw
  modified_base (273)..(273): a, c, t, g, unknown or other
  misc_feature (273)..(273): n is a, c, g, or t
  modified_base (327)..(327): a, c, t, g, unknown or other
  misc_feature (327)..(327): n is a, c, g, or t
  modified_base (350)..(350): a, c, t, g, unknown or other
  misc_feature (350)..(350): n is a, c, g, or t
  modified_base (377)..(377): a, c, t, g, unknown or other
  misc_feature (377)..(377): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaatgggagtgggctggactccgtcacgccccaggaaacgcccnggagtggcttgcgctctatttagtgggatgagtagtaagcactacacgtccgtntactagaagacaggctccaccanccacaagaccacctccaaacaaaccgnggtacgtccttaaacaaatcgaaacccaatacgtacggaccctggtacgacacacgccaacattattactgttacacgtctacgtagttggtacggggtattacttacgttcccttagtttacgacgtaccgttcggggactaaggggtaaccttcggtacggttcctaacccggttcctacccggaacgtaccggtcccctacccggaccaaccggggtccctacgtttcccccggg

SEQ ID NO: 359551 - DNA, 677 bp, Homo sapiens
  misc_feature: GZ8MTXP02I8LBI.17.33.C11.1.454.CMB.2.raw
  modified_base (218)..(218): a, c, t, g, unknown or other
  misc_feature (218)..(218): n is a, c, g, or t
  modified_base (279)..(279): a, c, t, g, unknown or other
  misc_feature (279)..(279): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacacgacccctcacgctgacctgccaccttctctggcttcncactcagaacgagtaggaagtgggagtgggctggactccgtcacgccccgaggaacggccnggagtggcttgcgtctctatttagttgggataggagagtaagactactacgtacgtccgtctacgtagaaacgacacggtacctacccaccctaactaccaaaccgaaacggaaccctaaccctaccaaaacctaaaacccggtacggttaccggttaacccttaaacgaaacgtacgaaaccctaaagttaacgtccggtaaacccgttggacgaaaccaccacgacccaaactatatttaaaccgtcgttacgactacttacgtaggttcgggggttacgggttattacgttaccgttactacgtttagacgtacgtcgggaccgtagggtactcgtcggtacctacgtccgtcggaaccgtctacccaccgaccgtaccgggacctacgtccccg

SEQ ID NO: 359552 - DNA, 595 bp, Homo sapiens
  misc_feature: GZ8MTXP02I7HCC.17.33.C11.1.454.CMB.2.raw
  modified_base (170)..(170): a, c, t, g, unknown or other
  misc_feature (170)..(170): n is a, c, g, or t
  modified_base (294)..(294): a, c, t, g, unknown or other
  misc_feature (294)..(294): n is a, c, g, or t
  modified_base (370)..(370): a, c, t, g, unknown or other
  misc_feature (370)..(370): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctnactgactgtgtccccaggagggacagtcactctcacctgtgcttccaacactggagcagtcaccagtgcttactatccaaactggttccagcagaacctggacaagcaccaggcactcatttanagtaacaaacaacaaacactcctacggacccctgcccgtatctcgagcctcccctcgtggggaacacgtctccgcncgacctcgtcgtcgtgtcgtcgcgacgtcgtaggacggacggacggtcgtacgtacttacgttacgtaccgtaccgttacttacgtttacggtttggtggttcgtcgtgtacgtacgttcggtacgggcgggtaacggacgacgtcgtacgtacgttacgtacgtacgaccgacgtacgccgtcccgtccgtcgtcaccgttctcccgtccctccgtccttaccg

SEQ ID NO: 359553 - DNA, 664 bp, Homo sapiens
  misc_feature: GZ8MTXP02I04E3.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaatgggagtgggctggactccgtcacgccccgaaggaacggcccgtggagtggcttgcgctctatttagtgggatgagagtaagcactacagtccgtctacgtagaaagaacgagcctacccaccactaccaaaccaaacggacccaccctacccgaaacaaacccgtagggttaccgtacccttaaacaacgtacgaaaccctaaagtaccgtacggaacccttagggacgaacccacgacgacccaaatacttactttacgtcgttaccaacgtcttacgtagttacgggttacgggtatttacttccggtaccttcgtttagacctacggttacggggacctaaacggggtacttccggacggttacccacccggttcctaccgccgtaccggtcccctaccgaacccgaacggcccctacggttcccccg

SEQ ID NO: 359554 - DNA, 617 bp, Homo sapiens
  misc_feature: GZ8MTXP02F14NC.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtggctggactccgtcacgccccgaggaacggccctggagtggcttgcgctctagtttagtgggatggagagtaagcactactacgtcccgtctcgtagaaagacgaggctaccaccatacaaccgaacggaccaccctaccaaaccaaaaccgtaggtacgtaccttaacaagtacgaaacctaatacgtacgacccgtagtacgaacacgacgtacccataacttattaacctggttaccacgtcttacgtaggtgggttaccggggtatttacgttacgttcccttagtttacgacgtacggtcggggaccaggggtaacctcggtacgtacctaccgtctccgctacgccctaccaaccgacggccctacgtcccgg

SEQ ID NO: 359555 - DNA, 546 bp, Homo sapiens
  misc_feature: GZ8MTXP02JGRKF.17.33.C11.1.454.CMB.2.raw
  modified_base (276)..(276): a, c, t, g, unknown or other
  misc_feature (276)..(276): n is a, c, g, or t
  modified_base (278)..(278): a, c, t, g, unknown or other
  misc_feature (278)..(278): n is a, c, g, or t
  modified_base (280)..(283): a, c, t, g, unknown or other
  misc_feature (280)..(283): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (301)..(302): a, c, t, g, unknown or other
  misc_feature (301)..(302): n is a, c, g, or t
  modified_base (306)..(306): a, c, t, g, unknown or other
  misc_feature (306)..(306): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagcggggctgggacacggcgacgaccctaggaagcctggngngnnnntntntgtgngngagagannacancgtcgtctnagaganacgcnccacacacacacacacncacacagcgtactacanacacatanacgacgngcgacacacacactactactactactcactactcgtacgtacggttacggttagttagttacgttcgttacgttacgtacgtacgtacggtacggtacggtacgtacgtacgtccgtaccgtccgtccgtaacgaccgtaccgtaccgaccgtaccgtaccgtaccgtccg

SEQ ID NO: 359556 - DNA, 729 bp, Homo sapiens
  misc_feature: GZ8MTXP02FUG7G.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcacgccccgaggaaacggccctggagtggcttgcgctctatttagtgggatggagagtaagcactacagttccctctcgtagaaagaacaggcctacccaacctactaccaaccgaaacggacccaaccctacccaaaccaaaacccgtaggggttaccggttaccctttaaacaaactaccgtaaaccctaaagttaacgtacgggtaaccccttggtacggaaccacgaacaccctaactaacttactttaccgtacggtttaccaccggtactttaccgttaaagggttcggggttaccgggtaaggtttacttaccgtttaccccttagtttacgtacgttaccgggttacggggaccgtaacggggtaacctttcggtacggttacccgtaacccggttcccgttacccgtaaccgaccggtacccctacccgaacccggaaccggggtccccctaacggttttcccccggg

SEQ ID NO: 359557 - DNA, 659 bp, Homo sapiens
  misc_feature: GZ8MTXP02JSMI6.17.33.C11.1.454.CMB.2.raw
  modified_base (217)..(217): a, c, t, g, unknown or other
  misc_feature (217)..(217): n is a, c, g, or t
  modified_base (330)..(330): a, c, t, g, unknown or other
  misc_feature (330)..(330): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgcctaccttctctggcttcncactcagaacgagtggaagtgggagtgggctggactccgcacgccccgaggaacgccgtggagtgcttgcgtctctatttagtggatgagagtaagcaactacgacgtccgtntcgtagaaacgacgacgctacccaccactaccgaaccgacggaccaccctaccaaaccgaaaccgtacggttaccgtacctaaactaactaacgtaaacctaagttacgtaccggaccttaggacgacaacgacaccaactattacgttactcgttaccacgttcgttagttacgggttggggttacggtattttaaccgttacgttccctttaagtttacgaccgttacgggttacgggaccggtaacgggtaccttcggtacggtaccctcccgttccgccgaacacccgccctacgaacccgaccggtccctaccgtttcccccgg

SEQ ID NO: 359558 - DNA, 645 bp, Homo sapiens
  misc_feature: GZ8MTXP02H0J75.17.33.C11.1.454.CMB.2.raw
  modified_base (214)..(214): a, c, t, g, unknown or other
  misc_feature (214)..(214): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttcncactcagaacgagtaggaatggggagtgggctggactccgtcacgcccccaaggaaacggccctggagtggcttgcgctctatttagtggatggagagtaagcactacagtccgtctctagaagaacaggctacccacactcaaaccaacggaccaccctccaaaccaaaaccacggtcgttaccttaacaaacttacgaaaccctaaatacgtacggacccctggtaggaaaccaccgacgacccaactattacgttaacttcgtttaccacgtcttacgtaacggttggggttaccggggtaagtttaacgttttacgtaccctttaacgtttacgaacttacgggtcggggacgtaacggggtacttcggtacgtccgacccgtctccgaacgccgacctcccgaccgacgggtccctagttccccgg

SEQ ID NO: 359559 - DNA, 627 bp, Homo sapiens
  misc_feature: GZ8MTXP02GXCDH.17.33.C11.1.454.CMB.2.raw
  modified_base (343)..(343): a, c, t, g, unknown or other
  misc_feature (343)..(343): n is a, c, g, or t
tcagcgtagactagcacgaccggtgctcgatttagagtgagctcgttgggtttgggggcgccagggtcccttccaatatcagcaccatggcctggactcctctctttctgttcctcctcacttgctgcccagggtccaattctcagactgtggtgactcaggagcctcactgactgtgtccccaggagggacagtcactctcacctgtgcttccaacactggagcagtcaccagtgcttactatccaaactggttccagcagaaacctggacaagcacccgaggcactcatttatagtaacaaaacaacaaacactcctacggacccctcgacccgtattccncacggtcctcccccgtccgttcggggacaaacgctacgccctgacactgtcgtggtgtcgacagccgtagacggacgaggctcgactattacctgacccttactaccgtttacgtttgggttcgggttcgtcgtttggtcgtaccgttagttccggggtacgggacgggtaccgaaagtccgtacgtaccgttacgttaacgtacgacgacccgaaacgtccgtccgtcccccgtaacggtcctaccgttccctccgtttaccccacccccgttccgttccccg

SEQ ID NO: 359560 - DNA, 559 bp, Homo sapiens
  misc_feature: GZ8MTXP02IRPOH.17.33.C11.1.454.CMB.2.raw
  modified_base (175)..(175): a, c, t, g, unknown or other
  misc_feature (175)..(175): n is a, c, g, or t
  modified_base (185)..(185): a, c, t, g, unknown or other
  misc_feature (185)..(185): n is a, c, g, or t
  modified_base (362)..(362): a, c, t, g, unknown or other
  misc_feature (362)..(362): n is a, c, g, or t
  modified_base (384)..(384): a, c, t, g, unknown or other
  misc_feature (384)..(384): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (425)..(425): a, c, t, g, unknown or other
  misc_feature (425)..(425): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccanacagaccctnacgctgacctgcaccttctctggcttctcactcagaacgagtggaaatggggagtgggctggatccgtcagcccccaggaaaggccctggagtggcttgcgctcatttattgggatgagagtaagcactacagtccgtctctgaaagaacaggctccaccaacacacaacgacaccnccaacaaacagtagtctacaananacaatanagaccngtgacacanacacatatatatctacnctctactaggttgggtaggttagttacgtacctacttacgtacgtacgtacggtacggacggaacggtacgtacgtcgtaccgtaccgtccgtccgacgaccgtaccgacccgaaccggaacccgaccgtaccg

SEQ ID NO: 359561 - DNA, 558 bp, Homo sapiens
  misc_feature: GZ8MTXP02H41QG.17.33.C11.1.454.CMB.2.raw
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (406)..(406): a, c, t, g, unknown or other
  misc_feature (406)..(406): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccgtcagccccaggaagccctggagtggcttgcgctcatttattgggatgagagtaagcactacagtccgtctctagaagaacaggctccacatcacagacacctcacaaacngtagtcctanatgaccaatatggaccctgtgacacagaccaaatnttactgttcacgacttctagtgggttacgggtattatacgttccctaatttcgacgtacgtcgggggcctaggggaacctcgtacgggtaccaccgtctcccggctaacgtcccctaccgaaccgaacgggcccctagttcccggttccccc

SEQ ID NO: 359562 - DNA, 745 bp, Homo sapiens
  misc_feature: GZ8MTXP02FN3OR.17.33.C11.1.454.CMB.2.raw
  modified_base (185)..(185): a, c, t, g, unknown or other
  misc_feature (185)..(185): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctnacgctgacctgccaccttctctggtcttctcactcagaacgagtggaatgggagtgggctggatccgtcacgccccgaggaacggcctggagtggcttgcgctctatttagtgggatggagagtagcactacagtcccgtctcgtagaaacgaacgaggcctaccaccctactaccgaaccaaacggacccaaccctacccaaaccgaaaacccgtagggttacggtaccctttaaacgaaacgttaccgaacctaaacgtaacgttacgggtaaccccgttacgggtacgaacccgaaccgtaacgaccccgtaaataaacgtttactttaaaccgtttacggttaccgtaaccggtccttacgtttaacggttagggggttttacccgggggtaagtttttaccgtttaacgttccccgtttaacgtttacgtaacgttaaccggttcggggaccggtaacggggtaacttaccgttcggggttaccctaccgtccgttaccggcctaaccggtcccgtacccgaacccgtaaaccgggtccccgacgtttccccggg

SEQ ID NO: 359563 - DNA, 563 bp, Homo sapiens
  misc_feature: GZ8MTXP02FJ12Z.17.33.C11.1.454.CMB.2.raw
  modified_base (527)..(527): a, c, t, g, unknown or other
  misc_feature (527)..(527): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgatctgcaccttctctggcttctcactcagaacgagtggaatgggagtgggctgggatccgtcacgcccccaggaaggcccgtggagtggcttgcgctctatttagtggatgagagtaagcactacagtccgtctctagaagaacaggccctacaccatcaaccaaggaccacctaccaacaaaccaggtcgtaccttaacaatcgaaccaaatagtcggaccctgtcggacacgaacgcaacattattactgttacacgtcttcgtagttcggttcgggtatttacttacgtcccttagtttcgacttacggtggggccaggtacctcgtcgtacnccgtctcgctacgccctaccaccgaccggctaccgg

SEQ ID NO: 359564 - DNA, 639 bp, Homo sapiens
  misc_feature: GZ8MTXP02HWEIN.17.33.C11.1.454.CMB.2.raw
  modified_base (455)..(455): a, c, t, g, unknown or other
  misc_feature (455)..(455): n is a, c, g, or t
  modified_base (471)..(471): a, c, t, g, unknown or other
  misc_feature (471)..(471): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaagtgggagtgggctggactccgtcacgccccgaggaacgcctggagtggctgcgctctatttagtggatgagagtaagcactacacgtccgtctcgtagaaagacgaggctacccacctacaccaaccgaaacggacccaaccctaccaaaccgaaaccgtaggtccgttacccttaaacaaactacgaaacctaaatacgtacggacccttgacgacaccganaccacattacttactnttcacgtctacttggtcggttagggtatttacttacggttcccttagttacgtacgttacgggtcgggacccgtaagggtaacctcggttcgtacccgtaaccggttccccgtacccgaaccgtacccgtaccctacccgaacccggaccggtcccttaccgtccccg

SEQ ID NO: 359565 - DNA, 605 bp, Homo sapiens
  misc_feature: GZ8MTXP02GY87R.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcctaccttctctggcttctcactcagaacgagtggaagtgggagtgggctggactccggcacgccccgaggaacgcctggagtggctgcgtctctatttagtggatgagagtagcatacagtccgtctactagaaacgacgagcctaccacactacaccgaacgaccacctaccaacaaaccgtggtacgtaccttaacaatacgacctaatacgtacgacctgacgacacgagaccatattacttactgttcacgtctcgtagtggttacgggtatttgttacgtccttagtttacgacgttacggcggggtacgtacgggtaccttcggtacgtccgtacccggttcgccccggaacgacccgtacccgtacccgaaccggtaaccggcccctaacggtttccccgg

SEQ ID NO: 359566 - DNA, 592 bp, Homo sapiens
  misc_feature: GZ8MTXP02G4KIW.17.33.C11.1.454.CMB.2.raw
  modified_base (226)..(226): a, c, t, g, unknown or other
  misc_feature (226)..(226): n is a, c, g, or t
  modified_base (299)..(299): a, c, t, g, unknown or other
  misc_feature (299)..(299): n is a, c, g, or t
  modified_base (456)..(456): a, c, t, g, unknown or other
  misc_feature (456)..(456): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtcccaggaggacagtcactctcacctgtcgcttccaacactggancagtcaccagtgcttactataccaaactggtccagcaagaacctggacaagccacccgaggcactctatttanagtaacaaacaaacaaacactaccgtacgacccctggaccctattcctacgacggtcctcccccgttcggttacggggacaaacgtctacggccctgaacctacgtgtaccgtgggtagtcgcacgccgtaggacggacgaggcctagtctaattcngacccttagtacttacgttggagtcgcgttgtcgtcttacgtcgggacggtaggaccagtctggaccttagttaagccgaacgaccgacgcctcccgcccgtgtacctaccgtctaccgtacccctacctctaccc

SEQ ID NO: 359567 - DNA, 565 bp, Homo sapiens
  misc_feature: GZ8MTXP02G8RKX.17.33.C11.1.454.CMB.2.raw
  modified_base (437)..(437): a, c, t, g, unknown or other
  misc_feature (437)..(437): n is a, c, g, or t
  modified_base (529)..(529): a, c, t, g, unknown or other
  misc_feature (529)..(529): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaatgggagtgggctggatccgtcacgccccgaggaacgcccgtggagtggcttgcgctctagtttatgggatgagagtaagcactacacgtccgtctctagaagaacgagctaccaccactcaaccaaggaccaacctacccaaacaaaccgacggtacgtaccttaacaaatacgaaacaatagtcgaccctagagacacagccanatattactgtcacgtctatagtggtcggtattagtacgtaccttagttacgacgtagtacgggtacgaggtactcgtacgtccgtaccgtcnccgcgacgaccctaccacgacgcccgtactccccgg

SEQ ID NO: 359568 - DNA, 618 bp, Homo sapiens
  misc_feature: GZ8MTXP02JVFP0.17.33.C11.1.454.CMB.2.raw
  modified_base (212)..(212): a, c, t, g, unknown or other
  misc_feature (212)..(212): n is a, c, g, or t
  modified_base (564)..(564): a, c, t, g, unknown or other
  misc_feature (564)..(564): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtncttaccaacacgtggagcagtcaccagtgacttactataccaaactggttaccagcagaaacctggaacaacgccacccgaggacactctatttataagtaacaaacaaacaaacactccgtcgacccctcgcccgacttctcacggcctaccccccgtccgttcggggactaaacgctacggccctggaccacgtcgttccgtggtcgtcgccgacgccgtggacggacggaggcgtgtactacttacgtcgtcctaccttcgttacgtttggtggtgtcgttgtgtcgtaggtcggacgggtacggacgagtcgtacgtaccgttacgtacgtcgacgaccgaacgtccnccggtcccccgtcggtacctaccgtcgttcccgtccccgtccctccgtttcccg

SEQ ID NO: 359569 - DNA, 619 bp, Homo sapiens
  misc_feature: GZ8MTXP02IAQCO.17.33.C11.1.454.CMB.2.raw
  modified_base (300)..(300): a, c, t, g, unknown or other
  misc_feature (300)..(300): n is a, c, g, or t
  modified_base (372)..(372): a, c, t, g, unknown or other
  misc_feature (372)..(372): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttccaacactggagcagtcaccagtgcttactataccaaactggttccagcagaaacctggaacaagcaccgaggcactcatttanagtaacaaacaaacaaacactccacgaccctgccgattctcacggcctccccgtccgttaggggacaagtcncgcctgactactgtctggtgtgcacgcctggacggacgaggctagtactattactcgtctactcgttacgtttggcggttgcgttgtcgtcgttacgttcggggacggaacgggtaccaggcgtacggtaccgttccgtttaaaggccgtaacggaccccgtaacggggtcccttcccgggccccccgttaaccggtcctaccccgttcttccccgtttaccccctaccccctttccctttaccccg

SEQ ID NO: 359570 - DNA, 635 bp, Homo sapiens
  misc_feature: GZ8MTXP02HK9SY.17.33.C11.1.454.CMB.2.raw
  modified_base (309)..(309): a, c, t, g, unknown or other
  misc_feature (309)..(309): n is a, c, g, or t
  modified_base (354)..(354): a, c, t, g, unknown or other
  misc_feature (354)..(354): n is a, c, g, or t
  modified_base (382)..(382): a, c, t, g, unknown or other
  misc_feature (382)..(382): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtcccagggagggacagtcactctcacctgtgcttccaacactggagcagtcaccagtcgtcttactataccaaacgttggttccagacaacgaaacctggaacaacgcaccgaggacactctatttanagtaacaaacaacaaaacactaccgtcggaccctcgccgtattcncacggcctccccgtcgtggggacaagcncgcctgactactcgtcgtggtcgtcgctacgcgtaggacggacggacgtcgtacggtaacttaacgttacgtcgtaccttacttacgttacgttttcgggtggttcgtcgtggtcgtcgttacgttcgggacggtacgggacaacggtcgtcggtaccgttacgttaacgcgacggtaccgaacggtccgttcccgtccccgtcggtacctaccgttccgtccgtttcccccggtccccttaccgtttacccg

SEQ ID NO: 359571 - DNA, 544 bp, Homo sapiens
  misc_feature: GZ8MTXP02F9MAQ.17.33.C11.1.454.CMB.2.raw
  modified_base (298)..(298): a, c, t, g, unknown or other
  misc_feature (298)..(298): n is a, c, g, or t
  modified_base (416)..(416): a, c, t, g, unknown or other
  misc_feature (416)..(416): n is a, c, g, or t
  modified_base (441)..(441): a, c, t, g, unknown or other
  misc_feature (441)..(441): n is a, c, g, or t
  modified_base (445)..(445): a, c, t, g, unknown or other
  misc_feature (445)..(445): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccaacactggagcagtcaccagtgcttactatccaaactggttcccagcagaaacctggacaagcacccaggcactcatttanagtaacaaacaacaaacactcctggacccctgcccgattctcagctcccctccgttggggcaaagctcgcctgacactgtctggtgtcgcgagcctgaggacgaggctgactagtacngctactctactttggtggtgctgtncgtnttcgggcggacggcaaagtcgtcgtacgtctaaacgtcgacgaccaacgcctcgtcccccgtcgtccgcttcctccgtttccccgcccctccttacccg

SEQ ID NO: 359572 - DNA, 524 bp, Homo sapiens
  misc_feature: GZ8MTXP02HP5PA.17.33.C11.1.454.CMB.2.raw
  modified_base (415)..(415): a, c, t, g, unknown or other
  misc_feature (415)..(415): n is a, c, g, or t
  modified_base (433)..(433): a, c, t, g, unknown or other
  misc_feature (433)..(433): n is a, c, g, or t
  modified_base (470)..(470): a, c, t, g, unknown or other
  misc_feature (470)..(470): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaaacctggacaagcaccaggcactcatttatagtaacaaacaaacaaaacactcctaggacctctgcccgattctcaggccctccctccgttggggacaaagctgccctgacactgtctggtgtgcagcctgaggacgagctgactatacngctatctactttggtgtntctgtgctagttcggcggaggaccaagctgaccgttntaacgtcacgcccaaggcctcgcccccgtggtccactctcgttcccgccctccc

SEQ ID NO: 359573 - DNA, 716 bp, Homo sapiens
  misc_feature: GZ8MTXP02GVQZW.17.33.C11.1.454.CMB.2.raw
  modified_base (540)..(540): a, c, t, g, unknown or other
  misc_feature (540)..(540): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcaccgtgtcgtcttaccaactacgtaggacgcctagtaccaccgtagtacgtacttaactactacctaaacgttcggttaccagacaacgaaaccgtaggaacaacgcccaccgacggacactactaatttactaacgtaaacaaacaaacaaacctacctaccgtaccgacccctcgaccgtacttacgtcgacgtcctcccccgttcggtacggggacaacgtcgtccgcctcgacctctcgtcgtggtcacgtcacgtccgtaggacgggaccgtaggtctactacgttacgttaacgtccgtaccttacttacgttcggtttgggtgttcgngttaggtcgtacgttcggtcggacggggaacggaacgtacgtcgttaccggtaccgttaacgtttacgccggtaaaccgaccggtaaccggtcccgtccccggtccccggttaacggttaacccttccggttccgtttcccccggtccccggttaaccctttccccgtttacccgg

SEQ ID NO: 359574 - DNA, 612 bp, Homo sapiens
  misc_feature: GZ8MTXP02JBVC9.17.33.C11.1.454.CMB.2.raw
  modified_base (227)..(227): a, c, t, g, unknown or other
  misc_feature (227)..(227): n is a, c, g, or t
  modified_base (291)..(291): a, c, t, g, unknown or other
  misc_feature (291)..(291): n is a, c, g, or t
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggttccagcaagaacctggggacaagcaccaggcacncatttanagtaacaaacaacaaacnctacncggaacccctgcccgtactctcacggcctcccccgtccgttaggggacaaacgctcggccctggaccagtcgtctgggtatgcagtcctaggacggacggacgtcacgtacttacttacgtcgtcctacttcttaacgtttgggtcgtgtccgttggtactcgtttaggttacgggacggggacggtaccgaaggtcgttacggtaccgtttacgtaacgtacgaccgaccgtacggcctccggaccccgttcggtcctacgtcctccgtttccccgcctttccgttaccg

SEQ ID NO: 359575 - DNA, 630 bp, Homo sapiens
  misc_feature: GZ8MTXP02JT941.17.33.C11.1.454.CMB.2.raw
  modified_base (273)..(273): a, c, t, g, unknown or other
  misc_feature (273)..(273): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacacgaccctcacgctgacctgccaccttctctggcttctcactcagaacgagtggaatgggagtgggctggactccgtcacgccccgaggaacgccnggagtggcttgcgctctatttagtggatgagagtaagcactacgacgtccgtctacgtagaaacgacaggcctaccaccataccaaccgaacgaccaccctaccaaccaaacgtcggtacgtaccttaacaatacgaaacctaatacgtacggaccctggtacgacacgacgaccaactattacttacgtcgttcacgtctacgttagggttggggttacgggtatttacgttaccgttcccgtttagtttcggacgttacgggtcgggggtaccgtaacgggtaccttcggtcggtacctaccgttccgccgcgaccgtcccgtaccgaccggaccggtccctacgtttcccccgg

SEQ ID NO: 359576 - DNA, 640 bp, Homo sapiens
  misc_feature: GZ8MTXP02GB50F.17.33.C11.1.454.CMB.2.raw
  modified_base (297)..(297): a, c, t, g, unknown or other
  misc_feature (297)..(297): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcagaaacctggacaagccaccaggcactcatttanaagtaacaaaaaacaacaactctacgacccctcgcccgtattctacacggacctccccgtccccgttcgggggaccaaacggtaccgtcgccccgtacgaccaccgttcgtccgttgggttgtgaccacgcccgtggagggaacggacgacgtacgtaacttattaactcgtaccttaacttcttaaccggtttggtgggtgtcgtgtggtcttacgtcggggtacgggaacgggactaaaggctacggtacccttacgttaacgtcgaacgaccgaacggccgttcgccccccgttgtcccgtacttccgttaccgttccccaccccttcctccgttaaccg

SEQ ID NO: 359577 - DNA, 672 bp, Homo sapiens
  misc_feature: GZ8MTXP02GLJA3.17.33.C11.1.454.CMB.2.raw
  modified_base (204)..(204): a, c, t, g, unknown or other
  misc_feature (204)..(204): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttcnctggcttctcactcagaacgagtggaatgggagtgggctggatccgtcacgccccgaggaacggccctgggagtggcttgcgctctagtttagtgggatggagagtaagcactacagtccgtctctagaaagaacacggcctaccaccataccaaccgaacggaacccaacccgtacccaaaccgaaaaccgtacgggttaccggttaccctttaaacaacgttacgaaaccctaaaagttacgtaccgggaaccccgttggttacgaaaccaccgacgaccctaacattacgttactgttacacgtcttacgtagttggggttacgggtatttacgtttacgttacccttagtttacgacgttacggtcgggggacctaaggggtaaccttggtacggtcctacccggttcgcccgtaacgaccgaccttacccgaccggtaaccgggtcccctaggtttcccccgg

SEQ ID NO: 359578 - DNA, 638 bp, Homo sapiens
  misc_feature: GZ8MTXP02H2UPT.17.33.C11.1.454.CMB.2.raw
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggccttctcactcagaacgagtggaagtggggagtgggctggactcgcncgccccaggaagccnggagtggctgcgctctagtttatgggatgagagtaagcactacacgtaccgtctacgtgaaagaacgacggtctaccacctactaccaaaccgaaggaacccaccctccaaacctaaaaccgcgggttacgttaccttaacaaacttacgaaaccctaatacttacggaccctagtacgaacacgacaccaactatattacctagtttaccacgtctaccgttaggttggttccggggttaattacgtttcgtacccttacgtttacgacttaacggtcgggtaccgtagggtactcggtcggttacccgtaccgttacgcccgaacgaccgtacccaccgaaccgaaccggtccgtaccgtcccgg

SEQ ID NO: 359579 - DNA, 555 bp, Homo sapiens
  misc_feature: GZ8MTXP02I4QN3.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaggccctggagtggcttgcgctcatttatgggatgagagtaagcactacagtccgtctctagaaagacaggctccaccataccaaccaaggaccaccctccaacaaaccaggtcgtaccttacaatacgaaccaatatacggaccctgtacgacacacgacactatattactgttcacgtctcgtagtgggttacggggtatttagttacgtccttattgactacgtcgggacacgggactcgtcgtccaccgtctccgcgacgtcctaccaccgacggccctacgtcccg

SEQ ID NO: 359580 - DNA, 657 bp, Homo sapiens
  misc_feature: GZ8MTXP02JJ9UJ.17.33.C11.1.454.CMB.2.raw
  modified_base (343)..(343): a, c, t, g, unknown or other
  misc_feature (343)..(343): n is a, c, g, or t
tcagcgtagactagcacgaccggtgctcgatttagagtgagctcgttgggtttgggggactcctgtgccccactatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtgggagtgggctggactccgcacgccccgaggaacgcctggacgtggctgcgctctattagtgggatggagagtaagcactacgtagttcccgtttactagaaagaaacgnggtacctacaacccactaccaaccgaaacggaccaaccctaccaccaaaaccgtacgggtacgttacctaacaatacgaaacctaaagtacgtaccggacccgttggtacggaaccaacgacgaccctaactagttaacttacgtgttaccacgtcttacgtagttcggggttacggggttatttacgttacgttccctttaatttcggtaacgtacggtcgggggtaccaacggggtacttcggtcggtaccgtaccggtcctccgactaaccgaccctaccgaaccgaccggtccctacgtcccggttaccc

SEQ ID NO: 359581 - DNA, 673 bp, Homo sapiens
  misc_feature: GZ8MTXP02JD012.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgaccccaggaaacggccctggagtggcttgcgctctatttagtgggatgaagagtaagcactacgacgtccgtactactagaaagaacgaggactacccaaccataccaaaccgaacggtacccaaccctacccaactaaaacccgaggggtacgtacctttaacgaacttacgaacctaaatacgtacggaccctggtagacacgacgaccacattacttactgtttaccacgtctacgttaggttcgggttacggggtatttagttaccggttaccttacgtttagaccgttacggtccgggggtaccgtaggggtaaaccttcggttacggtacccgacccgttacccgtcccgaaccgtacccggtacccctaccccgaaccgaaacccggggtccccctaacggtttcccccgg

SEQ ID NO: 359582 - DNA, 574 bp, Homo sapiens
  misc_feature: GZ8MTXP02I5FXU.17.33.C11.1.454.CMB.2.raw
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (530)..(530): a, c, t, g, unknown or other
  misc_feature (530)..(530): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacnctggancagtcaccagtgcttactatccaaactggttccagcagaacctggacaagccacccgaggcactctatttatagtacaaacaaacaacactcctcggacccctgcccatcctcacggtcctcccctccgtggggcaaacgctcgccctgacctactcgtactggtgtcgcgaacgccgtaggacggacgagacctagaactattactcgtacctctaccttacgtttggtcggtgtcgtgtcgcttgtcgggcggaacgggtaccagcgtcgaccgttcgtaacgtcgacgaccgacgtccncccgtcccgtcggtccacttcctcgttcccctaccctcctaccg

SEQ ID NO: 359583 - DNA, 650 bp, Homo sapiens
  misc_feature: GZ8MTXP02JFDEN.17.33.C11.1.454.CMB.2.raw
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
  modified_base (392)..(392): a, c, t, g, unknown or other
  misc_feature (392)..(392): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccagggagggacagtcactctcacctgtcgccttccaacnctggancagtcaccngtcgcttactactaccaacgtcggtaccagacaagaaaccnggacaacgccaccgaggcactctatttanaactaacaaacaaacaaactacctccgaccgaccctcgccgtatcacgcgtcctccccgtcggtcgggacaagctcgcccngactcgtcgtcgtggtcgtcgcgacgccgtaggacggacgacggtcgtacgtacttacgtactcgtaccttacgttacgttacgtttgggtagtcgtcgttcgggtacttcggttaacggttcgggaaccggggaacgggacctacggtcgtacggttaccgttaacgttaccgtacggaaccgaccggtaacgcccgttcccgtccccgtcggtaccctaccgttcccgttccctacccccgtacccttcctacccg

SEQ ID NO: 359584 - DNA, 619 bp, Homo sapiens
  misc_feature: GZ8MTXP02FHZ8H.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccgaggaaacggccctggagtggcttgcgctctatttagtggatgagagtagcactacagtccgtctcgtagaaagaacgacggctacccaccacgtaccaaaccgaaacggaccaaccctacccaaaccaaaaccgtagggttacgtaccttaacgaaattacgaaaccctaaagtacgtacggacccgttgtacggaaccacgacgaccaactatacttacgtcgtacacgtctcgtagtggggttacgggtatttacgttacgttcctatttacgacgttagtcggggactagggtactcgtacggtccacccgtctaccgcgtacgaccctaccgaccgaaccggcccacgttccccg

SEQ ID NO: 359585 - DNA, 617 bp, Homo sapiens
  misc_feature: GZ8MTXP02JBEAE.17.33.C11.1.454.CMB.2.raw
  modified_base (185)..(185): a, c, t, g, unknown or other
  misc_feature (185)..(185): n is a, c, g, or t
  modified_base (318)..(318): a, c, t, g, unknown or other
  misc_feature (318)..(318): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctnacgctgacctgccaccttctctggcttctcactcagaacgagtggaatgggagtgggctggactccgcacgccccgaggaaacgcccgtggagtggcttgcgctctattgttgggatgagagtaagcactacngtccgctcagaaagacagctccaccatacaacagaccacctccaacaaacgaggtacgtaccttaacaatacgaaacctaatacgaccggtaccctaggtacgaacacgacgaccaactataactttacgtacgtttaccacgtcttaccttaggttggggtttaccggggtatttaacgttacgttacccttacgtttagacgtacgtggggacccaagggtaacctcgtcggtacctacccgttccgaccgaaccgacgtaccctaccgaaccggtaacggccctacgttcccccgg

SEQ ID NO: 359586 - DNA, 735 bp, Homo sapiens
  misc_feature: GZ8MTXP02FSYL8.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgcttctcactcagaacgagtggaatgggagtgggctggatccgcacgcccccaggaaacggccctggagtggcttgcgctcatttatggatgagagtaagcactacagtccgtctctagaaagaacaggcctaccaccactaccaaccgaaacggaacccaaccctacccaaaccaaaacccgtagggttaccgtaccttaacaaacgtacgaaaccctaaagttacgtcggaacccgttaggtacggaaccaccgaacgcccaaataacttactttaaccttcgtttaccaaccggtcctttaccgttaaagggtttcggggtttaccgggggttaagttttaacgtttaccgggtttaccccctttaacgttttacggtaaccgttaaccgggttacgggggtaacccgtaaacgggggtaaaccttcggttacgggttacccgtaaccccggtccgttacccgaaccgtaccgaccccgttacccgaacccggtaaaccggggtccccctaacggtttccccccgg

SEQ ID NO: 359587 - DNA, 580 bp, Homo sapiens
  misc_feature: GZ8MTXP02HOIGX.17.33.C11.1.454.CMB.2.raw
  modified_base (327)..(327): a, c, t, g, unknown or other
  misc_feature (327)..(327): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (533)..(533): a, c, t, g, unknown or other
  misc_feature (533)..(533): n is a, c, g, or t
  modified_base (540)..(540): a, c, t, g, unknown or other
  misc_feature (540)..(540): n is a, c, g, or t
  modified_base (547)..(547): a, c, t, g, unknown or other
  misc_feature (547)..(547): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggactccgcacgccccgaggaacgccgtggagtcggcttgcgtctctatttagtggatgagagtaagctactacgagtccgtntctagaagaacngctccaccanacaaccgaagaccaacctaccaaacaaaccgtacggtacgtaccttaacaaatcgaaaccaatacgtcggaacctggtacgacacgacgaccaatatatttactcgttcacgtctacttaggttcggtacgggtattacttacgtccttagttcgacgtcgtacgggcaggactcgtcgtaccnccgttcncgtaacncgacctccgacggaccggtcctacgttccccgg

SEQ ID NO: 359588 - DNA, 574 bp, Homo sapiens
  misc_feature: GZ8MTXP02HVE7V.17.33.C11.1.454.CMB.2.raw
  modified_base (229)..(229): a, c, t, g, unknown or other
  misc_feature (229)..(229): n is a, c, g, or t
  modified_base (341)..(341): a, c, t, g, unknown or other
  misc_feature (341)..(341): n is a, c, g, or t
  modified_base (464)..(464): a, c, t, g, unknown or other
  misc_feature (464)..(464): n is a, c, g, or t
tcagcgtagactagcacgaccggtgctcgatttagagtgagctcgttgggtttggggggcgccaggggtcccttccaatatcagcaccatggcctggactcctctcttttctgttcctcctcacttgctgcccagggtccaattctcagactgtggtgactcaggagccctcactgacctgtcgtcccagggaggacagtcactctcacctgtgcttccaacactggancagtcaccagtgcttactatccaaacttggtccagcagaaacctgacacgcaccgaggcactcatttatagtaacaaacaacaaaacactactacggaccctgcccgattcncacggtcctcccccgtccgttcggggacaaacggctcgcccgtgacctacgtcgtacgtggtcgtgcacgccgtaggacggacgaggctagactactactcgcctactcttacgttggtgtgngtgtgcgtacgtcggacggacggaccagtctacgtaccgtacttacgcacgtaccgacgcctccgccccgtcggtcctacgtcctaccgtccccacccgttacctacccg

SEQ ID NO: 359589 - DNA, 633 bp, Homo sapiens
  misc_feature: GZ8MTXP02JN2PC.17.33.C11.1.454.CMB.2.raw
  modified_base (226)..(226): a, c, t, g, unknown or other
  misc_feature (226)..(226): n is a, c, g, or t
  modified_base (304)..(304): a, c, t, g, unknown or other
  misc_feature (304)..(304): n is a, c, g, or t
  modified_base (395)..(395): a, c, t, g, unknown or other
  misc_feature (395)..(395): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtcgcttactataccaaactcggttccagcaagaaacctggaacaagccacccgaggcactctatttanagtaacaaaacaacaaacactccgacggacccctcgaccgtattctcgacggtcctcccccgtccgtcggggacaaacgctcgcctgaccncgtgtcgtaggtcgtacgcacgccgtaggagggacgaggcgtagtactacttactcgtaccttacgttacgttacgtttggtcggttcgtcttggtcgtacgttacggttcggggacggacggaccgaagtcgtacggtaccgttacgttaaacgcgaaccggacccgtacggtcccgtccggtcccccgtaacggtcctaccgttccgtcccgttccccggtccctccgtttacccg

SEQ ID NO: 359590 - DNA, 700 bp, Homo sapiens
  misc_feature: GZ8MTXP02ICOXU.17.33.C11.1.454.CMB.2.raw
  modified_base (291)..(291): a, c, t, g, unknown or other
  misc_feature (291)..(291): n is a, c, g, or t
  modified_base (341)..(341): a, c, t, g, unknown or other
  misc_feature (341)..(341): n is a, c, g, or t
tcagcgtagactagcacgaccggtgctcgatttagagtgagctcgttgggtttgggggactcctgtgcccaccatggacacactttgctccacgctcctgctgctgaccatcccttcatgggtcttgtcccagatcaccttgaaggagtctggtcctacgctggtgaaaacccacacgacgaccctcacgctacgacctgcctacctttctcgtggtcttctcactcagacgagtagagtgggagtggcgtgactccgcgaccgacccgaaggaacgccgtggagtcggtntcgcgtctatagtttagtgggatgaagagtacgacactacgcgttccctntcgtaagaaacgtacgacgtctacccaaccactaccaaacgtaacggaaccccaccctaccaaaccgaaaccggtagggttccgttaacccttaacaacgtaaccgtaactaaagtacgtaccggtaaccgtggtacgaaccacgacaccatacttactacttgtaccgacgtccttacgttagggtacggggttacggttacgtttacgtttaccggttacctttaacgttcgtaaacggttcggtacgggggtacgagggttacccgttcgtaccgggttcccacccggttccctaccggaacctcccggtaaccctacccgaaaccggaacccggttaccgtaccggtttcccccg

SEQ ID NO: 359591 - DNA, 662 bp, Homo sapiens
  misc_feature: GZ8MTXP02JP4TB.17.33.C11.1.454.CMB.2.raw
  modified_base (297)..(297): a, c, t, g, unknown or other
  misc_feature (297)..(297): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtcaccagtgcttactataccaaactggttccagcagaaacctggacaagcaccaggcactcatttanagtaacaaacaacaaaacactaccgtacggacccctcgacccgtattcctcacggcctcccccgtccgttggggacaaacgctcgccctgacacgtgtctgggtgtcgcacgccgtaggacggacgaggctagactattactcgacctacgttcttacgtttgggtggttgtacgttcggtacgtacgttacggttccggggacgggacgggtaacccgaaggtccgtacggtaaccgttacgttaaacggtccgaaacggacccgaacgggtccccgtaaccggccccccggttaacgggtaccccttaaccggttcccgttacccgggtttcccccctacccccggtttccctttaaccccgg

SEQ ID NO: 359592 - DNA, 603 bp, Homo sapiens
  misc_feature: GZ8MTXP02I5NVI.17.33.C11.1.454.CMB.2.raw
  modified_base (404)..(404): a, c, t, g, unknown or other
  misc_feature (404)..(404): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtggggctggactaccggtcacgaccccaggaaagcccgtggagtggcttgcgctcatttagtgggatgagagtaagcactacgagtccgtctctagaaagacaggctaccaccactacaccaaggaccacctccaaaccaaaccgtaggtacgtaccttaacaatnaaacccaatacgtacgaccctggtgacacgacgaccacattacttactgttacacgtctcgttagtacgggttcgggtattacgtttacgtcccttagtttcgacgtacggtcggggacgacgggtaactcgtacggtcctaccgttccgaccgcgacgtcccaccgaaccggtaaccggcccctaacgtttcccccgg

SEQ ID NO: 359593 - DNA, 558 bp, Homo sapiens
  misc_feature: GZ8MTXP02HEXQT.17.33.C11.1.454.CMB.2.raw
  modified_base (319)..(319): a, c, t, g, unknown or other
  misc_feature (319)..(319): n is a, c, g, or t
  modified_base (381)..(381): a, c, t, g, unknown or other
  misc_feature (381)..(381): n is a, c, g, or t
  modified_base (424)..(424): a, c, t, g, unknown or other
  misc_feature (424)..(424): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgtcacgccccaggaagcctggagtggctgcgctcatttagtgggatgagagtaagcactacagtccgtntctagaaagaacaggctaccaccatacaacaagaccactccaacaaacaggtcgtaccttanaaatcgaaccaaatactacggaccctgtagacacgacaccaanatacttaactgttcaacgtctctaagttcgggtacggggtatttagttacgtcccttatttgaacttacgtcggggacctagggaactcgtgtcaccgtctccgcacgccctcaaccgacggtccacgtcccgg

SEQ ID NO: 359594 - DNA, 704 bp, Homo sapiens
  misc_feature: GZ8MTXP02GAKF9.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacacgacccctcacgctgacctgcctaccttctctggcttctcactcaagaacgagtaggaagtgggagtgggctggactccgtcgacgccccgaaggaaacggcccgtggagtcggcttcgcgtctctatttgtgggataggaagagtaagctaactacgacgtccgtctacgtagaaacgaacgacggtcctaccccgaaccacgtaccaaccgtaacggacccaacccgtacccaaaccgtaaaccgtacgggttaccgtaaccttaacgaaactaccgaaacctaaagttacggtacggtaacccgtaggtaacggaacccacgaaccgacctaactattacttactcgttacacgttctacgttacggttggggttacggtagtttacttaccgttaccttacgtttacggacgtaacgggtcggggtaaccgtaaggttaccgttcgacggttacctacccgttccgtaccggaacctaccggtccctacccggaaccgaccggtccctacggtttccccg

SEQ ID NO: 359595 - DNA, 632 bp, Homo sapiens
  misc_feature: GZ8MTXP02IREHY.17.33.C11.1.454.CMB.2.raw
  modified_base (373)..(373): a, c, t, g, unknown or other
  misc_feature (373)..(373): n is a, c, g, or t
  modified_base (389)..(389): a, c, t, g, unknown or other
  misc_feature (389)..(389): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaaacgccctggagtggctgcgctctatttatgggatgagagtaagcactacagtccgtctctagaaagacaggctaccaccactcaaccaaggaccacctccaacaaaccnggtacgtacccttaanaaatcgaacctaatactcgaccctgtacgacacacgccaacatacttactgttacacgtcttacgtagtcgggttacgggtagtttacgttacgtccctttagtttacgaccgttaacggttcgggggaccgtaaaggggtaaccttccggtacggttacccgtacccggttccgttcccggaaccgtaccggaccccttacccgaacccgtaaaccggggtccccctaacggtttcccccgg

SEQ ID NO: 359596 - DNA, 716 bp, Homo sapiens
  misc_feature: GZ8MTXP02HHJDC.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaaacccacacagaccctcacgctgacctgcaccttctctggcttctcactcaagaacgagtggaatggggagtgggctggactccgtcacgcccccaggaaacgccctgggacgtgggcttgcgctcatttagttggatgagagtaacgcactacagtccgtctctgaaagaacaggctaccaccaataccaaccgaaaaggtaccaaccctaccaaaccgaaaacaggttacgtacctttaaacaaactacgaaaccctaaagtacgttacgggaacccccttggacggaaccaacacggtaacccaaccgtaattaaactttaccttaggttacctaacgttcctacgtttaaggttccggggtttacgggggtattttaacgttacggttacccctttacgtttacgtaccgttaaaccggttcggggacccgtaaaggggtaaaccttccgttcggtaacccgttaacccggtccgttacccggaacctacccggtacccctaccccgaaacccgtaaccggggcccctaacgtttcccccggg

SEQ ID NO: 359597 - DNA, 668 bp, Homo sapiens
  misc_feature: GZ8MTXP02JBE46.17.33.C11.1.454.CMB.2.raw
  modified_base (148)..(148): a, c, t, g, unknown or other
  misc_feature (148)..(148): n is a, c, g, or t
  modified_base (188)..(188): a, c, t, g, unknown or other
  misc_feature (188)..(188): n is a, c, g, or t
  modified_base (311)..(311): a, c, t, g, unknown or other
  misc_feature (311)..(311): n is a, c, g, or t
  modified_base (326)..(326): a, c, t, g, unknown or other
  misc_feature (326)..(326): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggngtctggtcctacgctggtacgaaacccacacagacccctnacgctgacctgccaccttctctggcttctcactcagaacgagtggaatgggagtgggctggactccgtcacgccccgaggaacggcctggagtgcttgcgtctctattagtggatgagagtancactacacgtcgtcnctagaagacacggctacccacctactaccaaaccgtaacgacccaccctaccaaaccgtaaaccgtacggttaccgtaaccttaaacgaaacgtaccgtaaaccctaaatacgtacggaaccctgtacgacctacgacgaccaagtatacttactacgttacacgtcgttacgttaggttagggttccggtaagtttacttaacgttccctttaagttacgtaaccgttacgggtacggggtacctaacgggtaaccgttcgttaccggtacccgtacccggtcctcccgaacgttacccggccctaacccggaccgtaacggcccctttaacggtcccccg

SEQ ID NO: 359598 - DNA, 597 bp, Homo sapiens
  misc_feature: GZ8MTXP02J0TDX.17.33.C11.1.454.CMB.2.raw
tcagcgtagactagcacgaccggtgctcgatttagagtgagctcgttggggtttgggggactcctgtgccccaccatggacacactttgctccacgctcctgctgctgaccatcccttcatgggtcttgtcccagatcaccttgaaggagtctggtcctacgctggtcgaaacccacacagaccctcacgctgacctgcaccttctctggcttctcactcagaacgagtggaatggggagtgggctggactccgtcacgcccccaggaaacggccctggagtggcttgcgctctatttattgggatggagagtaagcactacacgtccgtctctagaagacaggctccaccatcaaccagaccacctccacaaacgcggtgtaccttacaactgaacctaatactcggtaaccctggtacgacacacgccaacatattactgttccacgcttctaagttgggttacggggtatttacgttacgttcccttacgtttgacttacggtacggggccgtagggtaaccttcgtcggtacctacccggtctacccggcgaacgtccctaccgaacccgtaacggtccctacgttccccggg

SEQ ID NO: 359599 - DNA, 695 bp, Homo sapiens
  misc_feature: GZ8MTXP02GG51Q.17.33.C11.1.454.CMB.2.raw
tcagcgtagactagcacgaccggtgctcgatttagagtgagctcgttggggtttgggggactcctgtgccccaccatggacacactttgctccacgctcctgctgctgaccatcccttcatgggtcttgtcccagatcaccttgaaggagtctggtcctacgctggtcgaaacccacacagaccctcacgctgacctgcctaccttctctggcttctcactcagaacgagtggaatgggagtgggctggactccgtcacgccccaggaacggcctggagtggtctagcgctctatttagtgggatgagagtaagcactacgagtccgtctcgtagaaacgacaggctaccaccactacaaccaacggaacccacctacccgaaacaaaccgtaggttcgtacctacaacgtaaactacgaactaaatacacgggtaaccctggaacggaccaacgaacgacccaaactaacttaactttaactcggttaccaccggtcttacttaggttacgggttacgggggttaatttacgttttacgtcccgtttaacgtttcgtaaccgttacgggtaccggggtaccgtaaacggggttaacctccgggttacggtaccctacccccggggttactccccggtaccgaaccggtcccccgttaacccgaaccccgggaaacgggtccccccgtttaccgg

SEQ ID NO: 359600 - DNA, 646 bp, Homo sapiens
  misc_feature: GZ8MTXP02IM9JS.17.33.C11.1.454.CMB.2.raw
  modified_base (412)..(412): a, c, t, g, unknown or other
  misc_feature (412)..(412): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttccaacactggagcagtcaccagtgcttactactaccaaactgttccagcaagaaacctggaacaagccacccgaggcactctaatttataagtaacaaaacaacaaaacactcctacgacccctcgacccgtattcctcacggtcctcccccgtccgttcggggacaaacgctcgccctgactactgtcgtggtgngcagccgtaggaggacgaggctagtaacttagttaactcgtaccttacttccgttacgttttggtcggttgtcgttgtcgtacgttacgttcgggcggaacgggaccgaacgtcgtacggtaccgtacgtttaacgtaccgaacgacccgtaacggcccgttccggtcccccgttaacggttcctaacccgttcccgttacccgttaccccctaccccgtttccctttaccccg

SEQ ID NO: 359601 - DNA, 625 bp, Homo sapiens
  misc_feature: GZ8MTXP02JWFEJ.17.33.C11.1.454.CMB.2.raw
  modified_base (185)..(185): a, c, t, g, unknown or other
  misc_feature (185)..(185): n is a, c, g, or t
  modified_base (280)..(280): a, c, t, g, unknown or other
  misc_feature (280)..(280): n is a, c, g, or t
  modified_base (318)..(318): a, c, t, g, unknown or other
  misc_feature (318)..(318): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctnacgctgacctgcaccttctctggcttctcactcagaacgagtggaatgggagtggctggatcgtcacgccccaggaagcctgagtggcttgccgntctattagtggatgagagtagacactacacgtcgtctntagaaacgaacgagctaccaccactacaacgacgaccacctccaacaaacgtagtacgtacctaacaactacgaaactaatacgtacgtaccgtagtacgacacacgtaccactacttaacgttaccttcgtaccacgtacgttacggttacggttgggtttacggggtaatttaacgttacggttaccctttacgttacgtaccgttacggtacggggtaccgtaaagggtaccttcgtacggtacccgtaccgtccgaccgtaaccgacgacccgtaccgaccggaccggtacccgtaccgtccg

SEQ ID NO: 359602 - DNA, 706 bp, Homo sapiens
  misc_feature: GZ8MTXP02IZPPM.17.33.C11.1.454.CMB.2.raw
  modified_base (175)..(175): a, c, t, g, unknown or other
  misc_feature (175)..(175): n is a, c, g, or t
  modified_base (185)..(185): a, c, t, g, unknown or other
  misc_feature (185)..(185): n is a, c, g, or t
  modified_base (213)..(213): a, c, t, g, unknown or other
  misc_feature (213)..(213): n is a, c, g, or t
  modified_base (311)..(311): a, c, t, g, unknown or other
  misc_feature (311)..(311): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccanacagaccctnacgctgacctgcaccttctctggcttcncactcagaacgagtggaatgggagtgggctggatccgtcacgaccccgaggaacgcctggagtgcttgcgctctattagtggatgagataagcactanacgtccgtctctagaaagacaggtcctaccaaccataccaacccgaaaggaccctaacctccaaaccaaaccgtacggggttacgttaacccttaacgaaagtacgtaaacccgtaaattaacgttacggaaccccgttggtaacgggaaccaacggacgaccctaacgtaacttactttaaaccgtggtttaccaaacggttcttaccgttaaaggttccgggggttacgggttaaggtttactttaccggttacccttacggttttacgaaccgttacggttacgggggaccaacggggttaaaccttcgcgggtttaccaacccggttcttaaccccggctaccggacccttacccggaaccgtaaaccggggccctaacgtttcccccggg

SEQ ID NO: 359603 - DNA, 753 bp, Homo sapiens
  misc_feature: GZ8MTXP02J3L34.17.33.C11.1.454.CMB.2.raw
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacacgaccctcacgctgacctgccaccttctctgtcttctcactcaagaacgagtaggaagtgggagtggctggactccgcacgccccgaggaacgcctggngtgctgcgctntattagtggataggaagagtaacgctaactacgtacgtcccgtctacgtagaaacgaaccgacggcctacccaaccgtaactacccgaaacccgtaacggaaccccaacccgtacccaaaccaaaacccggtgggtacgttacccttaacgaaacttacgaaaccctaaagtaccgtaccggtaacccgtgtaccgactaaccgaacgtacccaacttaacttacttaccgttacgttcccgacgtaccgtttacgtacgggtttacgggggtttacggtaacgttttaacgttaccgttacccgttaacgtttacgtaaccggttaccggttacgggggacccgtaacggggtaaccttccggttaccgggtaccccgtaacccggtcccgtaccccggaaccgtacccgtaccccgtaccccgaacccgggaacccgggttcccctaccggtttcccccgg

SEQ ID NO: 359604 - DNA, 606 bp, Homo sapiens
  misc_feature: GZ8MTXP02I5H9V.17.33.C11.1.454.CMB.2.raw
  modified_base (214)..(214): a, c, t, g, unknown or other
  misc_feature (214)..(214): n is a, c, g, or t
  modified_base (244)..(244): a, c, t, g, unknown or other
  misc_feature (244)..(244): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttcncactcagaacgagtggaagtgggagtgggntggactccgtcacgccccgaggaacggcctggagtggctgcgctctatttagtggatgagagtagcactacgacgtccgtctcgtagaaagaacgacggtcctaccacctaactaccaaaccgaacggaccaaccctaccaaaccgaaaccgtggttaccgtacctaacaacgtcaaaccaagtacgtccggaaccctggtacgaccacgacgtacccaatacttattaccgtcgttaccacgtcttagtcggttgggttacggtaattattaccgttccttagttgaccgtacggtcgggacagggtacctgtacggctaccggtctccgcgcgtcctaccgacgaccgcctacgtccccg

SEQ ID NO: 359605 - DNA, 842 bp, Homo sapiens
  misc_feature: GZ8MTXP02G33MF.17.33.C11.1.454.CMB.2.raw
  modified_base (245)..(245): a, c, t, g, unknown or other
  misc_feature (245)..(245): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtggctggntccgcacgaccccgaggaacgcctggagtgctgcgactctatttatgggatgagagtaagcacgtacacgtcccgtctacctaggaaagaacgacggacctacccgaaccccagtaccaaacccgaaaggacccaacccctacccgaaaccaaaaccggagggtttaccggtaccctttaaacaacgttacgaaaacccctaaattaaccgttaccgggaacccccgtttaggtacgggaaaccctaacccggaacgttaccccaaaataactttaaccgtttaaaccttacgggttttaaacccctacccggttaccgtttaacgggtttaacggggtttaccgggggtttaacccgggggtttaaacgtttttaaaccgtttaaccccggtttaccccgtttaaacggtttacccgggtaaacccgggtttaccgggtacccggggggtaaacccgttaaacgggggttaaacccctttccgggttaaccggttaaccccgttaaccccggttcccgttaccccgaaccgtaaccccggtaccccgttaccccggaaacccggtaacccgggtaccccttaccggtttcccccgg

SEQ ID NO: 359606 - DNA, 674 bp, Homo sapiens
  misc_feature: GZ8MTXP02JPP4F.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctggcttctcactcagaacgagtggaatgggagtgggctggatccgtcacgccccgaggaacgccctggagtggctgcgtctactagtttagtgggatgaagagtaagcactacagtccgtctacgtagaaacgaacgaggctacccaccataccaaccgaaacggtaccaaccctccaaaccaaaaccgtagggttaccgttaaccttaaacgaaacgttacgaaaccctaaattaacggttccgaaccccttagggtaacgaacaaccgacgaccctaactaacttactttaacgtcgttaccaacggtcttacgtaaggttcggggttacgggtaagttacgtttaccgtaccttaacgtttgaaccgttcggtacggggtaccgtacggggtaactcggttacggtccctaccggtcctacggctaccgacccgtacccgaacgaccggtaccctacttccccgg

SEQ ID NO: 359607 - DNA, 624 bp, Homo sapiens
  misc_feature: GZ8MTXP02GBZNG.17.33.C11.1.454.CMB.2.raw
  modified_base (305)..(305): a, c, t, g, unknown or other
  misc_feature (305)..(305): n is a, c, g, or t
  modified_base (326)..(326): a, c, t, g, unknown or other
  misc_feature (326)..(326): n is a, c, g, or t
  modified_base (380)..(380): a, c, t, g, unknown or other
  misc_feature (380)..(380): n is a, c, g, or t
  modified_base (392)..(392): a, c, t, g, unknown or other
  misc_feature (392)..(392): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcacagtgcttactataccaaactggttaccagcaacgaaaccgtggaacaacgccaccgaggcactacatttanagtacaaacaacaaacactcncgaccctcgccgtatcgtcggcctccgtcccgtggggacaacgctgccctgacncgtgtctgtgtncgagcctgaggacgaggctgtactacttacgtcgtccttacgtctttacggtttcgggtggttcgtgtcgtggtacgttacggtcggggacgggtaacgggaaccgaaggtcgtacggtacccgttacgttaacgtccggtaacggaccgaacggtccgtacccgtccccgttacggtaaccttcccgttccgttcccgttccccggtccctttaccgttacccgtttacgg

SEQ ID NO: 359608 - DNA, 546 bp, Homo sapiens
  misc_feature: GZ8MTXP02GAJAA.17.33.C11.1.454.CMB.2.raw
  modified_base (295)..(295): a, c, t, g, unknown or other
  misc_feature (295)..(295): n is a, c, g, or t
  modified_base (463)..(463): a, c, t, g, unknown or other
  misc_feature (463)..(463): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttanagtaacaaacaacaaaacactcctacggacccctcgaccccgtattcctcacggtcctccccccgttccgttcgggggacaaaacgctcgccctcgaccacgtcgtcctggtgtcgcagcctgaggacgaggctgactatactgcctactctacttggtgtgcttgtnctagttcggcggtaggaccagcgtcgacgtctagtcacgaccgacgcctcgccccgtcgctactcctcgtcccaccctctacc

SEQ ID NO: 359609 - DNA, 606 bp, Homo sapiens
  misc_feature: GZ8MTXP02IASL2.17.33.C11.1.454.CMB.2.raw
  modified_base (415)..(415): a, c, t, g, unknown or other
  misc_feature (415)..(415): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtcccaggagggacagtcactctcacctgtgcttccaacactggagcagtcaccagtgcttactatccaaacttggtccagcagaaacctgacaagcaccgaggcactcatttatagtaacaaacaaacaaaacactacctacggacccctgacccgtatcctacgacggcctcccccgtccgtttagggggacaaacggcttcggccccttgaccgtactgtccgtgggtggtcncgacgtcgaggacggacgacggcgtagtacttacttacgtcgtaccttacttaccgtttacgtttgggtggttgtcgttgtgtcgtcggtacgggcgggacggtaacgacgtacgtcgtacgtacgttacgacacgaccgacgccgtccgcccgtccgtcgtacctcgtcccgtcccgtacccttcctccg

SEQ ID NO: 359610 - DNA, 651 bp, Homo sapiens
  misc_feature: GZ8MTXP02GZWX8.17.33.C11.1.454.CMB.2.raw
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
  modified_base (364)..(364): a, c, t, g, unknown or other
  misc_feature (364)..(364): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggaggacagtcactcncacctgtgcttaccaacactggagcagtccaccagtgacttactactaccaaacgttggttaacagacaagaaacctggaacaagccacccgaggcactctattanaataacaaaacaaacaaaaccactccgtacgaccccctcgaccccgtattaccnccgaacggtccttcccccccgtccggttacggggacctaaacgcgttaccgccccttggacctacgtcgtcgttcggtgtcgacacgtccgtaggacggacggaggctagtaccttaagttactcgtacccttaacttcgttacgtttgggtaggttcgcttggtgtcgttacggttcgggacggagggtaaccgagacgtacgtacgtacgttaacgtcgacgaccgtacggcctccgtccccgtaacgtccaccgttcgtcccgttccctacccttcccttaccg

SEQ ID NO: 359611 - DNA, 694 bp, Homo sapiens
  misc_feature: GZ8MTXP02HIUPO.17.33.C11.1.454.CMB.2.raw
tcagcgtagactagcacgaccggtgctcgatttagagtgagctcggttgggtttgggggcgccaggggtcccttccaatatcagcaccatggcctggactcctctctttctgttcctcctcacttgctgcccagggtccaattctcagactgtggtgactcaggagccctcactgactgtcgtcccagggagggacagtcactctcacctgtgcttccaaacactggagcagtcaccagtgcttactactaccaaactggttccagcaagaaacctggaacaagccacccaggcactacatttataagtaacaaaacaaacaaaacactaccgtacggacccctcgcccgtattcctacgacggtcctaccccccgttcccggttacgggggacaaaacggctaccggacccgtcggaacctacgtcgttccgtgggttcgttcgccgtaacgcccgtggaacggaccggtaagggcttaggaccttaattaaccgtcgtacccttaactactttaccgtttggggttggttggtctggtcgtgttacggttcgggacggggacgggtaccgaaagtccgtacgtaccggtacgttaaacgtacgaccggaccgaacggccgtcccggcccccgtccggtacccgtaccctttccgtcccgtttacccccctacccctttccccgtttaccccg

SEQ ID NO: 359612 - DNA, 631 bp, Homo sapiens
  misc_feature: GZ8MTXP02GIGLB.17.33.C11.1.454.CMB.2.raw
  modified_base (278)..(278): a, c, t, g, unknown or other
  misc_feature (278)..(278): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (457)..(457): a, c, t, g, unknown or other
  misc_feature (457)..(457): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttccaacacgtggagcagtcaccagtcgcttactactacctaaactcggtccagcaacgaaccngacaacgacaccgaggcactnatttanaactaacaaaacaacaaaccactaccgtacgacccctcgaccctatcctacgacggtcctcccccgtcggtacggggacaacgctacgccctcgaacctcgtcgtcgtggtcgtcgcgacgcgtggaggacgaggtcgtacgacttattacncgtacctacttcgttacgtttgggtcggttcgtcgttgtcgtacgttacggttcggggacgggaacgggtaccgaacgtccgttacggtaccgttacgttaacgaccgaacgaccgacgtccgtcccgtacccgtccggtcctacgtcctaccgtcccctaccctccttacccg

SEQ ID NO: 359613 - DNA, 598 bp, Homo sapiens
  misc_feature: GZ8MTXP02G6XI5.17.33.C11.1.454.CMB.2.raw
  modified_base (226)..(226): a, c, t, g, unknown or other
  misc_feature (226)..(226): n is a, c, g, or t
  modified_base (294)..(294): a, c, t, g, unknown or other
  misc_feature (294)..(294): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggaggacagtcactctcacctgtgcttccaacactggancagtcaccagtgcttactatccaaactggtccagcagaaacctggacaagcaccaggcactcatttanagtaacaaaacaaacaaaacactacctcggaccccctgacccgattctcaacggtctccccccgtccgttgggggaccaaacgctacggccctggacctactcgtctggtgtcacagcctggaagacgaagggctagactagttactcgaccctacttaccttagtttggtggttgcgttgtcgtcgtacgttcgggacgggacggtaccaagcgtaggtaccgttacttaaggtccgaagcccgaacggtcctacgccccctaacggtcctaccgttcgtcctcccctacccgtcctttaccg

SEQ ID NO: 359614 - DNA, 736 bp, Homo sapiens
  misc_feature: GZ8MTXP02FYF9V.17.33.C11.1.454.CMB.2.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccagggacgggacagtcacctctccacctgtcgccttaccaacacgtggacgcagtccaccagtgcttactactaccaaacgttcggttaccagtacaacgaaaccgtaggacaacgacacccgaggcactcatttatagtaacaaacaacaaacactccgtacgacccctgacccgtattctcgacgtcctccccctcggtcggggacaaacgtcctacgccctcgacctacgtcgttaccgtcgggttacggtcgacaccgtccgttagggaacggggacgggtaacggacgttacgtaaccgttaacgtttaaccgtccgtaccccgtttacgttaccgtttaacggttttcgggttcggttgtccggttggttacgtacgtttacgggtttccggggacggggtaaacgggaccgtaacggtacgttacgtaacccggttaacgttaacggtaccgtacggacccgacgggtacctccccggtccccgttccggtcctaccgttcccgttacccggtttacccctaccccgttcccgtttaacccg

SEQ ID NO: 359615 - DNA, 607 bp, Homo sapiens
  misc_feature: GZ8MTXP02JPKSE.17.33.C11.1.454.CMB.2.raw
  modified_base (269)..(269): a, c, t, g, unknown or other
  misc_feature (269)..(269): n is a, c, g, or t
  modified_base (449)..(449): a, c, t, g, unknown or other
  misc_feature (449)..(449): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtggctggactccgcacgccccgaggaacgccnggagtgcttgcgctctattagtgggatggagaagtagcactacgagtcccgtctactagaaacgtacgacggctacccacactaccaaccgaacgacccaacctccaaacaaaccgtaggttcgtacccttaacaaactacgaaacctaatagtaccggacctggacgacacgacaccanacttacttactcgtacacgtctacgttagtgggttcgggtattacttacgtccttagttcgacgttacggcggggacctaagggtacctcggtacgggttaccccgtccgtccgccggaacaccgtcccctaccgaccggtacccgccttacgtcccg

SEQ ID NO: 359616 - DNA, 584 bp, Homo sapiens
  misc_feature: GZ8MTXP02GLJSU.17.33.C11.1.454.CMB.2.raw
  modified_base (226)..(226): a, c, t, g, unknown or other
  misc_feature (226)..(226): n is a, c, g, or t
  modified_base (554)..(554): a, c, t, g, unknown or other
  misc_feature (554)..(554): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggtccagcagaacctggacaagcaccgaggcactcatttatagtaacaaacaacaaacactcctcggacccctcgacccgtattctacacggtcctcccccgtccgttcggggacaaacgtctcgcctgacactgtctggtgtgcagcctggacggacggaggctagaaccttattactacgtcctacttcttacgtttggtcggtgtcttggtgcgttaagttcgggcggaacgggaccgaagcgtcgtaccgttcttaaagccgtacggacccgaacggcctcgcccccgtcggtaccnccttccgtcgtcccctacccgtccttcccg

SEQ ID NO: 359617 - DNA, 645 bp, Homo sapiens
  misc_feature: GZ8MTXP02HAOTP.17.33.C11.1.454.CMB.2.raw
  modified_base (337)..(337): a, c, t, g, unknown or other
  misc_feature (337)..(337): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaaacggccctggagtggcttgcgctctatttagtgggatgagagtaagcactacagtcccgtctctagaaagaanaggtctccaccactcaaaccgaaaggaccaaccctccaaaccgaaaaaccgacggttaccggtacctttaacgaaattacggaaaccctaaaagttacgtacggtaacccctggtacggaacaaccaacggaacccaactattaattaacctgttaccaacgtctacgtagttcgggttaggggtatttacgtacgttccccttatttagaccgtacggtcgggacccgaaggggtaaccttcggtacggtcctaaccgtccgtaccgcgacgtcccctacgacccgaacgggcccctacgtccccgg

SEQ ID NO: 359618 - DNA, 554 bp, Homo sapiens
  misc_feature: GZ8MTXP02JNFSZ.17.33.C11.1.454.CMB.2.raw
  modified_base (289)..(289): a, c, t, g, unknown or other
  misc_feature (289)..(289): n is a, c, g, or t
  modified_base (334)..(334): a, c, t, g, unknown or other
  misc_feature (334)..(334): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (415)..(415): a, c, t, g, unknown or other
  misc_feature (415)..(415): n is a, c, g, or t
  modified_base (486)..(486): a, c, t, g, unknown or other
  misc_feature (486)..(486): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcacagtgcttactatccaaactggtccagcagaactgacagcaccaggcactcatttanacgtaacaaacaacaaacactcctacggacccctgacccgattcncaggtcctccccgtccgtggggcaacgctacgcctgactactgtcnggtntgcagcctggagacgagctacgactagttcngcctactcttacgttggtgttgctgtgtacttacggtcgggcggtacgggaccaaggtcctaggaccgttntaaacggtcaccgacgacggtccttccggccctaacggtcctctacctcgttccccaccctctacccg

SEQ ID NO: 359619 - DNA, 704 bp, Homo sapiens
  misc_feature: GZ8MTXP02G4BFT.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgccaccttctctggcttctcactcgaagaacgagtaggaagtggggagtgggctggactccgtcacgccccgaaggaacggcccgtggagtggcttgcgtctctatttagtgggatggaagagtaagacactacgtacgtcccgtctcgtagaaacgaacgacggtcctacccaacctactaccaaaccgaaacggaacccaaccctacccgaaaaccgaaaaccgtacggggttaccgttacccttaaacaaacgttacgaaaccctaaattacgtacggtacccgtaggtacgaacacgacgaccaactaattaactttactcgttaccacgtcttacgttaggttcggggttacgggttatttacgttacgttccctttagttacgtacgttacggtcggggaccgtaaagggtaccttcggtacggtaccgtaccggttccgtaccgtaacgtaccgtaccccgtacccgaaccggtaaccgggtccctaacgtttcccccgg

SEQ ID NO: 359620 - DNA, 614 bp, Homo sapiens
  misc_feature: GZ8MTXP02G8A0A.17.33.C11.1.454.CMB.2.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcagaaacctggacaagccacccagggcactcatttatagtacaaacaaacaaacactcctcggaccccctgcccgatctcacgctccccctccgtggggacaaacgctgccctgacctactgtcgtggtgtcgcagccgtgaggacggaggctgactattactcgccttactcttacgtttgggtggttgtcttggtcgtcgttacgttccggggacgggtaacggggtaccaaacggtcgttacgtacccggttacttaaacggtcctacggaccccgtaaggccctcccggtacccccgtcgggtcctacccgtccttccgtttccccctacccccgtcccttaccccg

SEQ ID NO: 359621 - DNA, 804 bp, Homo sapiens
  misc_feature: GZ8MTXP02G8R4T.17.33.C11.1.454.CMB.2.raw
  modified_base (168)..(168): a, c, t, g, unknown or other
  misc_feature (168)..(168): n is a, c, g, or t
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
tcagcgtagactagcacgaccggtgctcgatttagagtgagctcgttggggtttggggggcgccagggggtcccttccaatatcagcaccatggcctggactcctctctttctgttcctcctcacttgctgcccagggtccaattctcagactgtggtgactcagganccctcactgactgtcgtcccagggaggacagtcactctcacctgtcgcttaccaacncgtggancagtcaccagtcgtacttactacgtacctaaacgtcggttccagacaacgaacccgtggaacaacgcccaccggtaggacactactatttaacgtaacgtaaaccaaaactaaaccaaaacctaccgtaccgtacccggtaccccctcgtaccccgtattccgtaccgacgggtcccttccccccgtacgggtacggggaacctaaacgggtcctaccgtacccgtagaaccgtaccggtttccgttaccggtggtcgggtcgtaccggaaaccgtcccggttaaagggaccggggaacggtacggtacccgttaacggttacccgttaactttacggtacccttaccggttacctttaaccgtttcgggttttacggggtggttaccgtcgttcgggtcggttaccggttacgttccgggggaacggtaacgggtacccgtaaggtccgtacccgggttaacctaggtttaccgacccgttaaccggacccgtaacgtcccgtacccgttaccccgttccggtacttacccgtcgtttaccccgtacccccttaccgtacctttaacccgg

SEQ ID NO: 359622 - DNA, 616 bp, Homo sapiens
  misc_feature: GZ8MTXP02FSQS0.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaatgggagtgggctggatccgtcacgccccaggaaacggccctggagtggcttgcgctctatttatgggatgagagtaagcactacagtccgtctctagaagaacaggctccaccatacaaccaaggaccacctccaacaaacaggtcgtaccttaacgaatcgaacctaaatactacggaccctgtacgacacacgaccatatattacgtgttaccacgcttactagttcgggttcggggtaattattacggttacccttacgttacgtaccgtacggttacgggggacctaaagggggtaccttacgttacgggtacccaacccgttcgtaccggaactacggaccccttaccgaaccgaaccgggtccctaacggtttccccg

SEQ ID NO: 359623 - DNA, 699 bp, Homo sapiens
  misc_feature: GZ8MTXP02I0LCL.17.33.C11.1.454.CMB.2.raw
  modified_base (306)..(306): a, c, t, g, unknown or other
  misc_feature (306)..(306): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtcgcttccaacactggagcagtcaccagtcgcttactactaccaaactcggttccagcaagaaacctggacaagccaccgaggcactactatttanagtaaacaaaaacaacaactacgtacggaccctacgccgtacttacctcgacgtaccgtccctacccgttcggggaccaaacgaccgtcggtaccctacgaccgtacgttcgttaccgttgggtcgttacggacgacgtcccgtaggacgggacgacggtacgtagtacttacgttaacctcgtacccttacgttactttacggtttcggttcgggtcgtcgttaggttcgtacgttaacggttcggggacggtacggggacaaacggtccgtacgtaacccgttacgttaacgtcgaacccggtccgaaacgggtccctaccggggtccccccttagggtcccgtaccttccgttacccgttaccccctacccttcccgtaccctttaaccg

SEQ ID NO: 359624 - DNA, 650 bp, Homo sapiens
  misc_feature: GZ8MTXP02GSEQV.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaatggggagtgggctggatccgtcacgcccccaggaaacggccctaggagtggcttgccgctcgatttagttgggatggagagtaagcactacacgtccgtatctagaaagaacaggctaccaccatcaaccaacggaccaaccctaccaaaccaaaacccgtagggttaccgtaaccctttaacaaacgttacgaaaacccaattaacgtacgggaaccccttggtacggaacaccgtagacccaactatacttactgttacacgtctacttagttcgggttacgggttatttagttacgttacccttacgtttagaccgttacggtacggggtccgaaacgggtaaaccttcggcggttaaccgcccgttcgtcccgccgacgcccctaccgaacccgacggcccctacgttccccgg

SEQ ID NO: 359625 - DNA, 563 bp, Homo sapiens
  misc_feature: GZ8MTXP02JX09A.17.33.C11.1.454.CMB.2.raw
  modified_base (424)..(424): a, c, t, g, unknown or other
  misc_feature (424)..(424): n is a, c, g, or t
  modified_base (528)..(528): a, c, t, g, unknown or other
  misc_feature (528)..(528): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaacggccctggagtggcttgcgctctatttatgggatgagagtaagcactacacgtccgtctctagaagaacaggctccaccatcaaccaaggaccacctccaacaaaccaggtcgtcctaacaatcgaaccaatatcggaccctgtagacacacgccanatattctgttcacgtctacgtagtgggttcgggtagtttacttacgttcccttatttacgacgttacgtcggggaccagggtaacctcgttggtcccaccgtcnccgcacgcctaccgaccaacgggcccagttccccg

SEQ ID NO: 359626 - DNA, 767 bp, Homo sapiens
  misc_feature: GZ8MTXP02JJR25.17.33.C11.1.454.CMB.2.raw
  modified_base (219)..(219): a, c, t, g, unknown or other
  misc_feature (219)..(219): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (319)..(319): a, c, t, g, unknown or other
  misc_feature (319)..(319): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgcctaccttctctggtccttcncactcagaacgagtggaagtgggagtcgggctggactccggcacgaccccgaggaacgccgtggagtgctggcnctntattagttggatgagaggtaacncactacgacgtctctacgtagaacgacgcgtacaccacactacaacgacgaccaccaccaaaccgtaaacggtacggtaccgttaacctaacgaacgtaaccgaaactaacgtacgtaccgacccgtagggtaaccgaacaaccgaccgtaacctaaacgttaactttaccgtttaccgttccgttaaccgtaccgtttacgttaacgggtttaccggggtttacgggggtttaaccgggttaaaccgtttttaacgtttccccggtttaacccgtttaaggtttaccggtaaacccgggttaaccgggggtacccgggggttaccgttaaacgggttaacccgttcggttacccgggtaccccttacccggttacccgaacccgtcccgtacccgtaccccgtaccccgtaacccggtaacccggtacccgttacccggttaccccg

SEQ ID NO: 359627 - DNA, 657 bp, Homo sapiens
  misc_feature: GZ8MTXP02GY54A.17.33.C11.1.454.CMB.2.raw
  modified_base (229)..(229): a, c, t, g, unknown or other
  misc_feature (229)..(229): n is a, c, g, or t
  modified_base (312)..(312): a, c, t, g, unknown or other
  misc_feature (312)..(312): n is a, c, g, or t
  modified_base (355)..(355): a, c, t, g, unknown or other
  misc_feature (355)..(355): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttccaacacgtggancagtcacctagtgacttacatacccaaactggttaccagacaagaaaccctaggacaagaccaaccgaggcactactatttanacgtaacaaacaaacaaacactacctcgacccctgccgtatcncacggctcccctcgtggggacaacgctcgccctcgacactcgtctaggtgtcgcagtccgtggagacggaggctacgactacttactcgtacctacgtcttaacgtttgggtggttgtcgttagtgtaacgttcggttacggggaccggacgggtaacctaacggcgtaacggtacccgttaacgttaacgttaccggacggttacccggaacgtcccgtaccccggtcccccgttaaccggtacccctaacgttacccggttccccgtttaccccaccccccggtttcctttaacccccgg

SEQ ID NO: 359628 - DNA, 669 bp, Homo sapiens
  misc_feature: GZ8MTXP02JGFVC.17.33.C11.1.454.CMB.2.raw
  modified_base (276)..(276): a, c, t, g, unknown or other
  misc_feature (276)..(276): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagacccctcacgctgacctgcaccttctctggcttctcactcagaacgagtggaagtgggagtggctggatccgtcacgaccccgaggaacggcccnggagtggcttgcgctcgtatttagtggatgaagagtaagcactacacgtcccgtctacgtagaaagaacaggtctaccaccataccaacgaacgaccacctccaaacaaaccgtacggtacgtacctaacaatacgaaaccaagtatacggaacccgtggtacgacacacgacccaatattacttactacgttcaaccggttctaccgttagggttacggggtttacggggtaacgtttaagtttaaacccggttcccctttaaaggtttacgtaaaccgttaccgggttacgggggacccgtagggggtaaaccctttcggtacgggtaccctacccgttccgcccggcctacgcccctaccgacccgaaacgggccctacgtttcccccgg

SEQ ID NO: 359629 - DNA, 656 bp, Homo sapiens
  misc_feature: GZ8MTXP02FNS5U.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaaacggccctggagtggctgcgctctatttagtggatgagagtaagcactacagtccgtctctagaaacgaacgacggctaccaccatacaaccgaaaggaccaccctacccaaccaaaaccgtacgggtacggttacccttaacgaaacttacggaaaccctaaagtacgtacgggtaccctggtacggaaccaacgacgacccaactattaacgtttacttacgttacaaccgttctaccgttaggttcggggtttaccgggggtaagtttaacgtttacggttacccttaactttcgaacttacggttacgggggacctaacggggtaactcgtcggtaccgtaccgtcgtaccgcgaccgtcctaccgaccgacggccctacgttcccgg

SEQ ID NO: 359630 - DNA, 658 bp, Homo sapiens
  misc_feature: GZ8MTXP02G19WH.17.33.C11.1.454.CMB.2.raw
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
  modified_base (426)..(426): a, c, t, g, unknown or other
  misc_feature (426)..(426): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtcccgagggaggacagtcactctcacctgtcgcttccaacactggagcagtcaccagtgcttactactaccaaactcggtaccagcaagaacctggaacacgcaccgaggcactanatttanaagtaacaaacaacaaacnctaccncggacccctgcccgtattcctacgacggtcctccccccgtcggttacggggacaaacgtccttacgccctgaacctcgtcgtacgtgggtcgtacncccgtaacccgtggaacggtaacgacggtacgtacgtacttacgtaacgtcgtacccttactacgtttacgtttggtcggtagtcgttggtcgtacgtacgttacgggcgggtaacggactacggtcgtacgaccggttactacgcgtaaccgccgtaaacggtccacccgtccccgtccgtaactaccgtccgttcccgttcccgccccctttacgtacccgtttacccgg

SEQ ID NO: 359631 - DNA, 647 bp, Homo sapiens
  misc_feature: GZ8MTXP02IQE43.17.33.C11.1.454.CMB.2.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (316)..(316): a, c, t, g, unknown or other
  misc_feature (316)..(316): n is a, c, g, or t
  modified_base (474)..(474): a, c, t, g, unknown or other
  misc_feature (474)..(474): n is a, c, g, or t
  modified_base (505)..(505): a, c, t, g, unknown or other
  misc_feature (505)..(505): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttccaacactggancagtcaccagtnctttactataccaaacgttggttaacagacaacgaaacctaggaacaacgccaacccgaggccactactatttanaagtaaccaaacaaacaaaccactcctacggacccctgaccctacttcacgacggtccttacccccgtccggttacggggacaaacgtctaccggccctcgactacgtcgtcgtggtgcgacacgtcgtaggacggacggagcgtagtacttataccncgtaccttacttcgttacgtttgggtggttntcgttgtacgtcgttaggtaccggggtacggacggaccgaagtccgtacgtacccggtacgttacgtaccgaacggaccgtacggcccttacccgacccggtcgtcctacttcccgtccgtaccccctcccttccttacccg

SEQ ID NO: 359632 - DNA, 610 bp, Homo sapiens
  misc_feature: GZ8MTXP02GP2TJ.17.33.C11.1.454.CMB.2.raw
  modified_base (289)..(289): a, c, t, g, unknown or other
  misc_feature (289)..(289): n is a, c, g, or t
  modified_base (434)..(434): a, c, t, g, unknown or other
  misc_feature (434)..(434): n is a, c, g, or t
  modified_base (460)..(460): a, c, t, g, unknown or other
  misc_feature (460)..(460): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccctctctggcttctcactcagaacgagtggaatggggatggctggactccgtcacgccccgaggaacgcccgtggagtggcttgcgctntattagtggatgagagtagcactacgacgtccgtctctagaaagtacacggctacccacatacaaccaacgaccacctccaaacaaaccgtggtacgtacctaacgaatacgaaaccaatacgtcggtacctggacgaacacganaccaactatacgttactgtacacgtntacgtagttggttacggtaattacgttacgtcccttagttacgtacgtacggttcggggacccgaagggtacctcggtacggtacctaccggtccgtaccgaacgtaccgacccgtacccgaacgaaccgggtccctacgtttcccccgg

SEQ ID NO: 359633 - DNA, 719 bp, Homo sapiens
  misc_feature: GZ8MTXP02G231N.17.33.C11.1.454.CMB.2.raw
  modified_base (233)..(233): a, c, t, g, unknown or other
  misc_feature (233)..(233): n is a, c, g, or t
  modified_base (315)..(315): a, c, t, g, unknown or other
  misc_feature (315)..(315): n is a, c, g, or t
  modified_base (429)..(429): a, c, t, g, unknown or other
  misc_feature (429)..(429): n is a, c, g, or t
tcagcgtagactagcacgaccggtgctcgatttagagtgagctcgttgggtttggggggcgccagggggtcccttccaatatcagcaccatggcctggactcctctctttctgttcctcctcacttgctgcccagggtccaattctcagactgtggtgactcaggagccctcactgactgtcgtccccagggagggacagtcactctcacctgtcgtcttccaacacgtggancagtcacagtgtcttactactaccaaactcggttaccagcaacgaaacctggaacaacgccaccgacggcactactatttanaagtaaccaaaacaaactaaaccaccgttccgtacgtaaccccctcgacccgtaacttccaccgaccggtcctaccccccgttccggggtacggggacctaaacgctcgtcccncggtactacgtcgtcgtgggtcgtcgcgacgtccgtggacggaccgaggccttaggtacttaacgttacccggtcgttaacccttcgttaacgtttaccgtttgggtggttcgtcgttacgttcgtacgtttacgtcgggggtacggacgggtaactacggtcttacggtacccgttacgtttaaacgacccgaggtaacccctaacggggtaccctacccgtcccccggttcgtaacccgttcccttacccgttcccggttacccccgtcccgtttaccctttccccgg

SEQ ID NO: 359634 - DNA, 666 bp, Homo sapiens
  misc_feature: GZ8MTXP02FX99L.17.33.C11.1.454.CMB.2.raw
  modified_base (212)..(212): a, c, t, g, unknown or other
  misc_feature (212)..(212): n is a, c, g, or t
  modified_base (224)..(224): a, c, t, g, unknown or other
  misc_feature (224)..(224): n is a, c, g, or t
  modified_base (297)..(297): a, c, t, g, unknown or other
  misc_feature (297)..(297): n is a, c, g, or t
  modified_base (468)..(468): a, c, t, g, unknown or other
  misc_feature (468)..(468): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgcttcncactcagaacgngtggaatgggagtgggctggatccgtcacgccccgaggaaggccctggagtggcttgcgctcatttagtggangagagtaagcactacagtccgtctacgtagaaagaacaggctacccaccactcaaccaacggaccaaccctccaaaccaaaccgaggtacgttaccttaacaatacgacctaaatacgtacggaccctgtacggaccagacgaccacatatttaaactcgttaccaacgtntacctagttaggggttaccgggagtttattacggttcccttacgtttcgtaacgttacggttacgggggaccctaaagggggtaaacccttcgttacgggttacccgtacccggtccgttaccccggaaccgtaaccgtacccccgttacccgaaaccccggaaaaccgggggtccccctaaggttttacccccccgg

SEQ ID NO: 359635 - DNA, 708 bp, Homo sapiens
  misc_feature: GZ8MTXP02JWOUL.17.33.C11.1.454.CMB.2.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtcccgagggacggacagtcactctcacctgtcgccttaccaacacgtggacgcagtccacgtagtgtacttactactacctaaacgttcggtaccagacaacgaaaccgtaggaacacgccaccggaggcactactatttataataaccaaaacaaacaaacctacctaccgtaccggacccctacggcccgttaacttccgtaccgtacggtcccttaccccccgttccgggtacgggggtaccaaacgggtccttcggaccccttagaaccgtcgtttcggttcgtggggtacgtcgccgacgtccgtagggacgggacggacggtcgtacgtaacttacgttactcgtaccttaccttacgttcggtttgggtggttgtcgttcggagttcgttacggtaccgggggacgggtaacggaccgtagacgtacggtaccgttacgttacgaccgaccggtaccgacggtccgtcccgtcccgtcgtaccttacgtacccgtccctcccgtacccttcctaccgg

SEQ ID NO: 359636 - DNA, 715 bp, Homo sapiens
  misc_feature: GZ8MTXP02IVYBU.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacacgaccctcacgctgacctgccaccttctctggcttctcactcagaacgagtggaagtgggagtgggctggactccggtcgacgccccgaaggaacggccgtggagtggcttgcgtctactagtttagtgggatgaagagtaagcactacgacgtccgtctactagaaacgaacgaggacctacccaccaactaccaaaccgaacggaacccaccctacccgaaaccgaaaccgtacgggtaccgttacctaaacaacgtacgaaacctaaagtacgtacggaccgttaggacgacaaccgacgaccctaaactacttaactttactacgtttaccgacgttacttacgttacgggttaggggtttacgggttaacgtttaacgttaccgttacccgtttacgtttacggtaaccgtacgggttacgggacccggtagggtaaaccgttcggtacggttacccgtacccgttccgacccgaaccgtaccggaccctaccccggaaccgaaccggtccccgttaacgtttcccccgg

SEQ ID NO: 359637 - DNA, 887 bp, Homo sapiens
  misc_feature: GZ8MTXP02GORE1.17.33.C11.1.454.CMB.2.raw
  modified_base (232)..(232): a, c, t, g, unknown or other
  misc_feature (232)..(232): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtcgtcttccaaacacgtggancagtcaccagtgacttactactacctaaacgtcggttaccagtacaacgaaaccgtaggaacaacgaccaacccgagggctaacctacttaaacttttaacgtaaacgtaaaaccaaaaaccgaaaacctaaaaccctaaccgtttaccccgtacccggaaccccccttacggacccccggttaactttacccgtaccgaaccgggttccccttacccccccggtttacccggggtttacggggggaaacctaaaaccgggtccgttacccggtacccccgttacgggaaccttaaccggtttcgggtttaccggttcgggggttcgttaccgggacctaccgggtaccggtacgggttaacggggaacgggtacgggtaccgttacggttaacctttaacttaaccgtaccgttacccgtttaacgtttaccgtttaacggtttttggggtacggtttcggttcgttcggttacgttaccgttacggttaccgggggaccggggtaaccgggaaccgtaacggtccggtaacggttacccgtttaccgttaacgtaccggtaccgaacccggtacggtcccgtacccgtcccccggttcgtaccgttaccttcccgttacccgttaccccctaccccgtttacccgtttacccg

SEQ ID NO: 359638 - DNA, 607 bp, Homo sapiens
  misc_feature: GZ8MTXP02ICRJU.17.33.C11.1.454.CMB.2.raw
  modified_base (307)..(307): a, c, t, g, unknown or other
  misc_feature (307)..(307): n is a, c, g, or t
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
  modified_base (481)..(481): a, c, t, g, unknown or other
  misc_feature (481)..(481): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttccaacactggagcagtcaccagtgcttacactaccaaactcggtccagcaagaaaccgtggaacaacgcacccgaggccactactatttanaacgtaaacaaacaaacaaacactaccgtcggacccctcgacccgtattcctcgacgtcctcccccgtacggttacggggacaaacgtcgtacgccctgactacgtcgtctgggtctgccagtccgngacgacgngctagtacttatactcgtacctacttcgttacgtttggnggtgtcgtgtacgtccgttaggtcgggacggacgacgacgtcgtacgtacgtacgttagcgacgaccgtacgccgttaccgccccgtcgccttaccgtcttcccggttacccctccttaccctccg

SEQ ID NO: 359639 - DNA, 611 bp, Homo sapiens
  misc_feature: GZ8MTXP02JA74F.17.33.C11.1.454.CMB.2.raw
  modified_base (314)..(314): a, c, t, g, unknown or other
  misc_feature (314)..(314): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggaggacagtcactctcacctgtcgccttccaacacgtggagcagtccaccagttcgactttactactacctaaactcggttccagacaacgaaacctggacaagccacccgaggcactcatttanataacaaacaaacaaacactcctacgaccctcgaccgtactctcacgcctcccctcgtcggggacaagctagcctgactacgtgtcgtgtgtgcacgcctaggacggacgaggctgaactattactcgacttacgttccttagttggtgtgtcgttgtcgtactaggtcggacgggacggacctacgtcgtacgtaccgttacgttaacgtaccgaacgtacccgaacgtcccgtccgacccccgtcgtcccggtaccttccgttccgtttcccccggtacccttccctttaacccg

SEQ ID NO: 359640 - DNA, 543 bp, Homo sapiens
  misc_feature: GZ8MTXP02IWSM9.17.33.C11.1.454.CMB.2.raw
  modified_base (280)..(280): a, c, t, g, unknown or other
  misc_feature (280)..(280): n is a, c, g, or t
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
  modified_base (433)..(433): a, c, t, g, unknown or other
  misc_feature (433)..(433): n is a, c, g, or t
  modified_base (515)..(515): a, c, t, g, unknown or other
  misc_feature (515)..(515): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaatggggagtgggctggatccgtcagccccaggaaacgccctggagtggntgcgctcatttattgggatgagagtaagcactacagtccgtctctagaagaacaggctccaccatcacaagaccacctcaacaaaccnggtacgtacctaanaatacgaacctaatatcgacctgtgacncagaccanatatactgtacacgntactagtggttcgggaagttattacgtccttatttagactagttcgggaccaagggtactcgtacggtcctaccgtctccgnacgcctccacgaacggccctatccccgg

SEQ ID NO: 359641 - DNA, 661 bp, Homo sapiens
  misc_feature: GZ8MTXP02JECHD.17.33.C11.1.454.CMB.2.raw
  modified_base (309)..(309): a, c, t, g, unknown or other
  misc_feature (309)..(309): n is a, c, g, or t
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcacctgtcgcttccaacacgtggagcagtcacagtctcttactactaccaaacgtcggttccagacaacgaacctaggaacaagccaccgaggcactacatttanataaaccaaacaacaaacnctctacggacccctgcctntcncacggtcctccccgtccggttaggggactaacggctacggcctgaccaccttgtcgtgggtgtcgcgtacgccgtggaacggacggcggtcgtacgtacttaacgtttacctcgtacccttacttaccgtttacgtttgggttcggtgtccgttggttacgtccgttaacggttcgggggacggtaacggggaaccgtacggtaccgtacggtaaccgttacttaacgtacgaccgtaacccggacggtcctcccggtccccgttcggtaccctaccgtcccttccggttaccccacccgtttaccttccg

SEQ ID NO: 359642 - DNA, 641 bp, Homo sapiens
  misc_feature: GZ8MTXP02IQCVS.17.33.C11.1.454.CMB.2.raw
  modified_base (277)..(277): a, c, t, g, unknown or other
  misc_feature (277)..(277): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtcgaaacccacacagacccctcacgctgacctgcctaccttctctggtcttctcactcagaacgagtggaagtgggagtgggctggactccgcacgccccgaggaacgccgnggagtggctgcgtctactatttagtgggatgagagtaacgacactacgacgttcccgtctcgtagaaacgacgtacggcctaccaccactaccaaccgaacgacccacctaccaaccaaaccgtacggttaccgtaccttaacaaatacgaacctaatacgtcgaccctggtacgacacgacgaccaatacttacttacgtgttaccacgttcttacgtttaggtcggggttacggttagtttacgtttaccgttacctttagtttacgacgttcggtacggggacctagggtaccttcggcgtaccgtccgttcgacccgcgtaccgcccgtaccgaccggaccggtccctacgtttccccgg

SEQ ID NO: 359643 - DNA, 648 bp, Homo sapiens
  misc_feature: GZ8MTXP02JXYBN.17.33.C11.1.454.CMB.2.raw
  modified_base (484)..(484): a, c, t, g, unknown or other
  misc_feature (484)..(484): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgcacgccccgaggaacggcctggagtggcttgcgctctatttagtgggatgtagagtaagctaactactacgtccgtactctagaaagaacacggctacccaccactaccaaccgaacgaaccaccctaccaacctaaaaccgacgggttacgtacccttaacaaacgtcgaaaccctaatagtccggaccgtggtacggaccacacgaccaactacttaacttactcgttacncgtctacgttacggtagggttacgggttaagtttacgttacgttacccgtttacgtttacgtacgttacgtcggggtacccgtaagggtacgttacgtcggtacctaccgtcccgtaccgccgtaccgccctaccgaaccgaccggtcccgacgtttcccccgg

SEQ ID NO: 359644 - DNA, 658 bp, Homo sapiens
  misc_feature: GZ8MTXP02FOWCX.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctgcttctcactcagaacgagtggaatgggagtgggctggactccgcacgcccccgaggaacggccctggagtggctgcgctctatttagtgggatgagagtaagcactacacgtccgtctcgtagaaagacacggcctacccacccataccaaccgaaacggacccaccctacccaaaccgtaaaacccgtagggttacgttacccttaaacgaaacgttacgaaacctaaattacgtacgggaacccttggtacggacaaccgacgacccaactattaacttactcgttaccacgtcttacgttaggttcggggttacgggtagtttaacttacggttacccttacgtttacgacgttacggtcggggtacctaggggtaactcggtacggtcctaccggtcctccgaacctaccggccctaccgaccgtacgggccctacggttccccgg

SEQ ID NO: 359645 - DNA, 589 bp, Homo sapiens
  misc_feature: GZ8MTXP02I1FWJ.17.33.C11.1.454.CMB.2.raw
  modified_base (295)..(295): a, c, t, g, unknown or other
  misc_feature (295)..(295): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggttccagcagaacctggacaagcacccgaggcactcatttanagtaacaaacaacaaacactcctcggaccccctgcccgtattctcacggcctccccctccgttggggacaaacgctcgccctgacactgtctggtgtgcagcctgagacgaggctgactattactgacctctacttacgtttggtcggttgacttggtcgcgttagttcgggcggaacgggaccaagcgtacggtaccgttacgtttaaagtcgacgacccgtaagggtcctccggcccccgtcggttcccaccgtttccctccgtttacccccggtccctttcccgtttcccg

SEQ ID NO: 359646 - DNA, 837 bp, Homo sapiens
  misc_feature: GZ8MTXP02F7NMM.17.33.C11.1.454.CMB.2.raw
  modified_base (177)..(177): a, c, t, g, unknown or other
  misc_feature (177)..(177): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccanacacgacccctcacgctgacctgcctaccttctctggtccttctcactcaagaacgagtggaagtgggagtgggctggactccgcacgaccccgaggaacgccgtggagtggctgcgctctatttagtgggatagagtagtaagctaactacgtacgtccgtctacgtaagaaacgtaacgacggtcctaccccgaacctacgtaccaaaccgtaaacggaaccctaaccctacccaaaccgtaaaaccggtacgggttaccgttacccttaaacgaaacgttaccgtaaaaccgtaaagtacgtaccgggtaacccgtagggttaaccggaaaccaaccgtaacggaacccctaaacgttaaactttaacctttaaaccgtttccggttaaccctaaacccggttcctttaaccgggtttaagggggttttaccggggtttaaaccgggggtttaaacgtttttaaccgtttaccccggtttaaacccgtttaccgtttaacgggtaaaaccgtttccggggtacggggttaacccggtaaaacgggttaacccgtttcggtaccggttacccgtaacccggttcccgttacccggaaccgttacccggacccttaaccccgtaaccggaacccgggtccctaccggtttacccccggg

SEQ ID NO: 359647 - DNA, 647 bp, Homo sapiens
  misc_feature: GZ8MTXP02GUL2Z.17.33.C11.1.454.CMB.2.raw
  modified_base (147)..(147): a, c, t, g, unknown or other
  misc_feature (147)..(147): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
  modified_base (472)..(472): a, c, t, g, unknown or other
  misc_feature (472)..(472): n is a, c, g, or t
  modified_base (503)..(503): a, c, t, g, unknown or other
  misc_feature (503)..(503): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtccagatcaccttgaaggngtctggtcctacgctggtacgaaacccacacacgaccctcacgctcgacctgcctaccttctcgtggtcctttctaccactacgaaggaacgtaggtagggaagtggggaggtggctggactccgtccgacgaccccgaaggacgccgtggagtggtctgccgtctattagttagtggataggagtaagacactacgtacgcgtccgtctacgagaacgacgacgactaccccgacacaccgaaaccgaacgtacccaccaccaaacaacgtcggtacgtacctaanacgtanaaacctagtcacggacctaggcgaactacganaaccctatacttacttacgcttacgaccgtntaccgttagggttcgggttacgtagtttaccttcggttacctagttcgaacgtcggacggtaccgaggtaccttcggacggtacctacccgtcgtaccggaactacccgtaccaccccggaccgaccgtcctacgtttcccccg

SEQ ID NO: 359648 - DNA, 632 bp, Homo sapiens
  misc_feature: GZ8MTXP02I0CCC.17.33.C11.1.454.CMB.2.raw
  modified_base (224)..(224): a, c, t, g, unknown or other
  misc_feature (224)..(224): n is a, c, g, or t
  modified_base (313)..(313): a, c, t, g, unknown or other
  misc_feature (313)..(313): n is a, c, g, or t
  modified_base (352)..(352): a, c, t, g, unknown or other
  misc_feature (352)..(352): n is a, c, g, or t
  modified_base (435)..(435): a, c, t, g, unknown or other
  misc_feature (435)..(435): n is a, c, g, or t
tcagcgtagactagcacgaccggtgctcgatttagagtgagctcgttggggtttgggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtcgcttccaacncgtggagcagtcaccagtgcttactataccaaacgtcggttaccagacaagaaacctggaacaacgccacccgagggccactcatttanagtaacaaacaacaaacactccacgaccctgccgtatcncagcctcccctcgtgggacaagctcgcctgactacgtgtcgtggtcgtcgcacgcgtgacggacgacgctagactacgttacncgtacctacttacgttagtttggtggttcgcgttcgtcgtcgtacggttaccgggacgggtacgggaccgtaacgcggttacgtacccggttacgttaacgccgtaacgtacccgtaacgggtccctacccggtacccccgttcggtacctaccgttccgttaccctacccccgtacccgttaccctttaaccccgg

SEQ ID NO: 359649 - DNA, 576 bp, Homo sapiens
  misc_feature: GZ8MTXP02HOJW3.17.33.C11.1.454.CMB.2.raw
  modified_base (363)..(363): a, c, t, g, unknown or other
  misc_feature (363)..(363): n is a, c, g, or t
  modified_base (388)..(388): a, c, t, g, unknown or other
  misc_feature (388)..(388): n is a, c, g, or t
  modified_base (426)..(426): a, c, t, g, unknown or other
  misc_feature (426)..(426): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtggggctggactaccggtcacgccccgaggaacggccctggagtggcttgcgctcatttatgggatgagagtaagcactacagtcgtctctgaaacgacaggctccaccatcacaaggaccaccnccgaacaaacaggtacgtccttaanatcgaacctaatatcgaccttgcgacacagaccctaanattacttactcgttacacgtactcgtaggttacgggttacggtagtttacgtacgttcttacttacgtacgtacggtcgggacgtaggtactcggtacgtaccgtaccgtccgccgcgacgaccgtaccgaccgaccgaccgtacgtccg

SEQ ID NO: 359650 - DNA, 588 bp, Homo sapiens
  misc_feature: GZ8MTXP02FHLCR.17.33.C11.1.454.CMB.2.raw
  modified_base (299)..(299): a, c, t, g, unknown or other
  misc_feature (299)..(299): n is a, c, g, or t
  modified_base (344)..(344): a, c, t, g, unknown or other
  misc_feature (344)..(344): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaaacctggacaagccaccaggacactcatttanagtaacaaacaacaaacactcctacggacccctcgcccgattccncgacggtcctcccccccgtccgttcgggggacaaacgctacgccctcgacactgtcgtgtgtgcagccgtgaggacgagactgacttatactcgtacctactctagttcggtggtgcgtgtgtcgttagtcgggtacggacgggaccaacgcgtacgaccgttacgtaaacgtacacggacccaacgtccgtccgtcccccgtcggtcctaccgtcctcctacccctacccctccctttacccg

SEQ ID NO: 359651 - DNA, 681 bp, Homo sapiens
  misc_feature: GZ8MTXP02IDG6X.17.33.C11.1.454.CMB.2.raw
  modified_base (301)..(301): a, c, t, g, unknown or other
  misc_feature (301)..(301): n is a, c, g, or t
  modified_base (439)..(439): a, c, t, g, unknown or other
  misc_feature (439)..(439): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctgggtacaaacccacacacgacccctcacgctgacctgcctaccttctctggcttctcactcaagaacgagtggaagtgggagtgggctaggactccgtcgacgaccccgaaggaacggccgtggagtcggctgctctntatttagtggatgaagagtaacgacactacgcgttccgtactcgtaggaaacgactacggcctacccaaccactaaccgaaccaaacggacccaaccctaccaaaccgaaaaccgtacgggttaccgtacccttaaanaacgtaacgtaaaccctaaagtacgtaaccgtaccgtaggtacgaaccactacgacctaatacgttaacgttaaccgttcgttacgacgtactacggttaaggttcggggttaccgggttaatttacgtttaccgttaccttagtttacgacgttacggcgggtaccgtaggacttcggacgtccaccgttccgaccgtcgaccgtacccgaccgaaccgacccggtacctacggttccccg

SEQ ID NO: 359652 - DNA, 632 bp, Homo sapiens
  misc_feature: GZ8MTXP02GKQ5U.17.33.C11.1.454.CMB.2.raw
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
  modified_base (319)..(319): a, c, t, g, unknown or other
  misc_feature (319)..(319): n is a, c, g, or t
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtcccgaggaggacagtcactctcacctgctcttaccaacnctggacncagtccaacctagtctacttactactaccctaaacgttcggttccagacaacgaaacctggaacacgccaccgaggcactactaattanaacgtaacaaacaacaaacnctccgcgacccngcctattcncgacgtcctccccgtcggtcgggacaacgctcgccgtgacctagtcgtcgtaggtcgtgaccacgtcgaggacggacgacggtctacgtacttacttaccgtcgtaccttcgttacgtttcggtttgggtcgttcgtcgttgttacgtcgttacggtcgggggacgaacggactacggtcgtacggtaccgtacgttacgccgtaccgaccggtacgcccgttacccgcccgtgtacctccgttccgtccccgtccctcccttacgttcccg

SEQ ID NO: 359653 - DNA, 675 bp, Homo sapiens
  misc_feature: GZ8MTXP02JRS5E.17.33.C11.1.454.CMB.2.raw
  modified_base (620)..(620): a, c, t, g, unknown or other
  misc_feature (620)..(620): n is a, c, g, or t
tcagcgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaaacggccctggagtggcttgcgctctatttatgggatgagagtaagcactacgagtcccgtctcgtagaaagaacaggcctacccaccataccaaccgaacggaaccaccctacccaaaccaaaacccgtacgggttaccggtacccttaacaaactacgaaaccctaaagtacgtacggacccctgtacggaaaccacgaacgccccaaatacttattaaccgttcgttacccaacgtccttacgttacgggttgggtttaccgggggtatttacgtttaaccgttccccttagtttaccgacgttacggttcggggaccctaaggggtaccttcggtcggtacccgtacccgttcncccgtcgaccgccccttacccgaccggaacgggtccccctaacggtttcccccgg

SEQ ID NO: 359654 - DNA, 599 bp, Homo sapiens
  misc_feature: GZ8MTXP02FP94E.17.33.C11.1.454.CMB.2.raw
  modified_base (392)..(392): a, c, t, g, unknown or other
  misc_feature (392)..(392): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaacgccctggagtggcttgcgctctatttagtgggatgagagtaagcactacacgtccgtctctagaaagacaggctaccaccatacaaccaagaccaccctccaaccaaaccaggtcgtacccttaanaactacgaacccaatacgtacggaccctaggtacgacacagacccatatattactgttacacgtctactagtggttacgggtagttacttacgtcccttagttacgacgttacgtcgggggtaccaggggtactcgtacgggtcctaaccggtctacccgcgtaccggtaccctacccgaccgaaccgggcccctaagtttccccgg

SEQ ID NO: 359655 - DNA, 698 bp, Homo sapiens
  misc_feature: GZ8MTXP02H8T1J.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccagtaaacggccctggagtcggcttgcgctctatttagtgggatgagtagtaagcactacacgtccgtctctagaaagtacgacggctccaccactccaaccaaggaccaccctccaacctaaaaccgaggttaccgtaccttaacaatacgaaccctaatacgtacggaccttggtacggacactagacccaactatacttactcgtacacgtctacgttagtacggggtttacggggtaatttacgtttacgttaccccgtttagtttacgtaaaccttacggggttaccgggggacccgtaacgggggttaaaccgtttcccggttacgggggttaccctaaccccggtttcccgttaccggggaaccctaaacccgggtccccttacccccggaaaccgaaacccgggggtcccccttaacggttttccccccggg

SEQ ID NO: 359656 - DNA, 618 bp, Homo sapiens
  misc_feature: GZ8MTXP02IAJ6E.17.33.C11.1.454.CMB.2.raw
  modified_base (229)..(229): a, c, t, g, unknown or other
  misc_feature (229)..(229): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgccccagggtccaattctcagactgtggtgactcaggagccctcactgactgtcgtccccagggagggacagtcactctcacctgtgcttccaacactggancagtcaccagtgcttactatccaaactggttccagcagaaacctggacaagcaccaggcactcatttatagtaacaaacaacaaaacactacctacggacccctgccgacttctacacggcctcccctccgttggggacaaacgctcgccctgaccactgtctggtgtgcacgcctgaggacgaggctagtactattactcgtcctacttcttacgtttggtcggttgtcgttggtgtcgttacgtcggggcgggtaacgggaccgaagtcgtacggtaccgttacgttaaacggtcaacggacccgtaacggtccgtcccgtacccccgtcgggtaccctacccgttccgttacccgtttccccctaccccgtttacccgttaacccg

SEQ ID NO: 359657 - DNA, 626 bp, Homo sapiens
  misc_feature: GZ8MTXP02IPLLN.17.33.C11.1.454.CMB.2.raw
  modified_base (148)..(148): a, c, t, g, unknown or other
  misc_feature (148)..(148): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggngtctggtcctacgctggtacgaaacccacacagaccctcacgctcgacctgcctaccttctctggccttctcactcaagaacgagtggaatggggagtgggctggactccgcacgaccccaggaacgccgtggagtggcttgcgctctagtttagtgggatgaagtagtaacgctaacgtacgtacgtcctctacgtagaacgacgacgtcacccgtactacaccgaacgaacgacctaccaccaacgaacgtaggtaccttactaacacgtaccaactaatacgaccgtacgtgaacgacaccgacactaataacttctacgttcgacctcgtcttacgttgggttacgggtacggttattacgttcgttaccttgtacgtacgtacggtacggaccggtacgtccgtcgtacggtcctaccgtccgtaaccgcgacccgtacccaacccgtaccggaccggtcctaccgttccccg

SEQ ID NO: 359658 - DNA, 759 bp, Homo sapiens
  misc_feature: GZ8MTXP02IQUCT.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtccagatcaccttgaaggagtctggtcctacgctggtagaaacccacacacgaccctcacgctgacctgctaccttctctgcttctcactcagaacgagtaggaatggggagtgggctggactaccgtcgacgaccccgaaggaacggcccgtaggagtggcttgccgtctactatttagttgggatggtagagtaagcactacacgtccgtctgtagaaacgacgacggcctacccaaccactacgaaacccgaaggacccaaccctaccaaaccgaaaacccgtagggttaccggtacctttaacgaaacgttacgaaaaccctaaagttaacgttaccgggtaaccccgttaggtaaccggaccaaccgacggtacccaaaaccgtatttaaacgttaccttacggtttacccaacgtttctaccgttagggttacggggttaccgggttaagtttacgtttaaccggtaccctttagtttaccggaaccgttacggttacggggaaccggtacggggttaaacctcggttacggtaaccgtaccccgggttacccgtacccgtaaccgacccgtacccgtaaccccggtaaccccggtaaccggtacccccgtttaccggtaccccg

SEQ ID NO: 359659 - DNA, 535 bp, Homo sapiens
  misc_feature: GZ8MTXP02HJRRR.17.33.C11.1.454.CMB.2.raw
  modified_base (185)..(185): a, c, t, g, unknown or other
  misc_feature (185)..(185): n is a, c, g, or t
  modified_base (323)..(323): a, c, t, g, unknown or other
  misc_feature (323)..(323): n is a, c, g, or t
  modified_base (364)..(364): a, c, t, g, unknown or other
  misc_feature (364)..(364): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
  modified_base (428)..(428): a, c, t, g, unknown or other
  misc_feature (428)..(428): n is a, c, g, or t
  modified_base (500)..(500): a, c, t, g, unknown or other
  misc_feature (500)..(500): n is a, c, g, or t
  modified_base (514)..(514): a, c, t, g, unknown or other
  misc_feature (514)..(514): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctnacgctgacctgcaccttctctggcttctcactcagaacgagtggaatggggagtgggctggatccgtcagcccccaggaaaggccctggagtggcttgcgctcgatttatgggatgagagtaagcactacagtccgtntctgaaagacaggctcaccatcacagaccactccacaaacngtcgtaccttacaatgaccaaatactacggacctgagacacganccanatattactgtcacgtntctagtcggtacgggattatacgtcccttattgactacgtcggggaccagggaactcgacggtcaccgttcnccgaaccgcgaccnccaccgacgaccgtacgtccg

SEQ ID NO: 359660 - DNA, 653 bp, Homo sapiens
  misc_feature: GZ8MTXP02FTDZZ.17.33.C11.1.454.CMB.2.raw
  modified_base (332)..(332): a, c, t, g, unknown or other
  misc_feature (332)..(332): n is a, c, g, or t
  modified_base (363)..(363): a, c, t, g, unknown or other
  misc_feature (363)..(363): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacacgaccctcacgctgacctgccaccttctctggcttctcactcagaacgagtaggaagtgggagtgggctggactccgtcacgccccgaggaacgcctggagtggctgcgctctatttagtgggatggaagagtaagcactacgacgtcccgtntacgtagaaagaacgacgctaccaaccgtanaccaaaccgaaacggtacccaacctccaaaccaaaaccgtaggttacgtaccttaagaaactacgaaacctaaatagtcgaaccgttggacgaacacgactcccaatacttagttactcgtacctagtcttacgtaggttacgggttacgggtaatttacgtacgttacccgttaatttcggacgtaacggtcggggacccaaagggtaccttcggtaacggtccctaccggtccttcccgaagtacccggtaccctaccgaaccggaacggtccccaggtttcccccgg

SEQ ID NO: 359661 - DNA, 663 bp, Homo sapiens
  misc_feature: GZ8MTXP02FK3AA.17.33.C11.1.454.CMB.2.raw
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
tcagcgtagactagcacgaccggtgctcgatttagagtgagctcgttgggtttggggggcgccagggggtcccttccaatatcagcaccatggcctggactcctctctttctgttcctcctcacttgctgcccagggtccaattctcagactgtggtgactcaggagccctcactgactgtgtccccagggaggacagtcactctcacctgtgcttccaacactggagcagtcaccagtgtcttactactaccaaacgtcggttccagacaacgaaacctggaacaagccaccgaggcactactatttaatagtaacaaaacaacaaacnctaccncggacccctgaccctatcncgacgtcctcccccgtcgtacggggacaacgctcgcctgacacgtgtcctggtgtcgccgtagccgtggaacggacgacgacgtacgacttaacgttacgtcgaccttacttacgtttccggtttgggtgggtcgtcgttggtacgtcgttacgtacgggggacggtaacggggacctaaggtcgttaccggtaaccgttacgttaaacggtcgtaaccggaccgtaacgggtccgtccccggttcccccgtccggtaaccttcccgttaccgtttcccgttaccccctaccccttcccgtttacccg

SEQ ID NO: 359662 - DNA, 581 bp, Homo sapiens
  misc_feature: GZ8MTXP02IWB8T.17.33.C11.1.454.CMB.2.raw
  modified_base (309)..(309): a, c, t, g, unknown or other
  misc_feature (309)..(309): n is a, c, g, or t
  modified_base (323)..(323): a, c, t, g, unknown or other
  misc_feature (323)..(323): n is a, c, g, or t
  modified_base (371)..(371): a, c, t, g, unknown or other
  misc_feature (371)..(371): n is a, c, g, or t
  modified_base (427)..(427): a, c, t, g, unknown or other
  misc_feature (427)..(427): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaaacggccctggagtggcttgcgctctatttagtggatgagagtaancactacagtccgtntctagaagacaggctacaccatacaacaagaccacctccaacaaaccnggtacgtccttaacaatcgaaccaatacgtcgaccctgtacgacaccgagcccaanatattactcgttaccacgtcttactagtcggggttaccggggtagtttattacggtccctttatttacgacttacgtcggggacctaggggtacttcgtcggtaccaccgtctccgcgaccgtcctaccgaccgaacgggccctacgttcccgg

SEQ ID NO: 359663 - DNA, 554 bp, Homo sapiens
  misc_feature: GZ8MTXP02H3PWV.17.33.C11.1.454.CMB.2.raw
  modified_base (148)..(148): a, c, t, g, unknown or other
  misc_feature (148)..(148): n is a, c, g, or t
  modified_base (319)..(319): a, c, t, g, unknown or other
  misc_feature (319)..(319): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (395)..(395): a, c, t, g, unknown or other
  misc_feature (395)..(395): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggngtctggtcctacgctggtgaaacccacacagaccctcacgctgaccctgcaccttctctggcttctcactcagaacgagtggaagtggggagtgggctggatccgtcagcccccaggaaacggccctgggagtggcttgcgctcatttatgggatgagagtaagcactacngtccgtntntagaanacagctccaccatcaacagacacctcacaaacgagtcgtaccttacaatacgaactaatancggtaccctaggtcgaacacgagccaacatacttactagttccacgtctactagttcgggtacggtagttagttacgtccttacttgacgtacgtcgggaccgtaggactcgcgttacacgtcctccgcgacgcctaccacgaccggcctaacgtcccg

SEQ ID NO: 359664 - DNA, 570 bp, Homo sapiens
  misc_feature: GZ8MTXP02JFEIN.17.33.C11.1.454.CMB.2.raw
  modified_base (247)..(247): a, c, t, g, unknown or other
  misc_feature (247)..(247): n is a, c, g, or t
  modified_base (296)..(296): a, c, t, g, unknown or other
  misc_feature (296)..(296): n is a, c, g, or t
  modified_base (452)..(452): a, c, t, g, unknown or other
  misc_feature (452)..(452): n is a, c, g, or t
tcagcgtagactagcacgaccggtgctcgatttagagtgagctcgttgggtttgggggcgccaggggtcccttccaatatcagcaccatggcctgggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactanccaaactggttccagcagaacctggacaagcacccaggcactcatttanacgtacaaacaacaaacactcctaggaccccctgccccgtattctccacggtcctcccccctcgttccgggggactaaaggctcgaccctgaccactgtcctggtcgttcgactacgcccgttagaaggaccgagtctagacctattactgacctntactactttggtgtgcgtgtacggcttacgttcggacgggagggaccaagtcgacgtacgtcttaaagcacgtccaaggctccgccctaaggtccactctccgttccgcccctctccc

SEQ ID NO: 359665 - DNA, 663 bp, Homo sapiens
  misc_feature: GZ8MTXP02FF15D.17.33.C11.1.454.CMB.2.raw
  modified_base (251)..(251): a, c, t, g, unknown or other
  misc_feature (251)..(251): n is a, c, g, or t
  modified_base (285)..(285): a, c, t, g, unknown or other
  misc_feature (285)..(285): n is a, c, g, or t
  modified_base (308)..(308): a, c, t, g, unknown or other
  misc_feature (308)..(308): n is a, c, g, or t
  modified_base (324)..(324): a, c, t, g, unknown or other
  misc_feature (324)..(324): n is a, c, g, or t
tcagcgtagactagcacgaccggtgctcgatttagagtgagctcgttgggttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcacctcagaacgagtggaatgggagtgggctggatccgtnaggcccccaggaaaggccctggagtggcttgcgntcatttattgggatgagagtaancaactacagtcccgtntctgaagacaggctccaccgatcaccaaggaccaccgtccaacgaaaacccagggtcggtaccttaacgaatagaacccaagttatcgggaaccctggtaggaccacacgacctacaacgttaattaactgtttacaaccgtcgtccgttaaggttcgggtttaccgggggaagtttacgttaacggttccccttaaccgtttagtaaccgttaccggttacgggggacccctagggggtaaaccttcgttcgggttaacccgcccggttccgttccccggaacttaaaccgccccgtacccctaccccgaaaacggggccccctaacgtttcccccgg

SEQ ID NO: 359666 - DNA, 682 bp, Homo sapiens
  misc_feature: GZ8MTXP02GX53F.17.33.C11.1.454.CMB.2.raw
  modified_base (329)..(329): a, c, t, g, unknown or other
  misc_feature (329)..(329): n is a, c, g, or t
  modified_base (383)..(383): a, c, t, g, unknown or other
  misc_feature (383)..(383): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcgaggacgccctcactgactgtcgtccccgagggagggacagtcactctcacctgtcgtccttaccaacacgtggagcagtccacgagtcgtacttactactacctaaacttcggtaccagacaacgaaaccgtggaacaacgccaaccgaggacactactaatttaanaacgtaacaaaacaaacaaaaccacctaccgtacggacccctcgaccctattcncgacggtcctcccccgtcgggtacggggactaaacgtccgtacgcccgtgaccctacgttcggttacgttgggttcgacggtcgacgggtccgtagggagggacggaggtcgtacgtaccttaacgtactccgtacttacgttgtttacggttggttcggtgtcgttggtcgtacgttacgggttacggggacggaacgggtaacacggtcgtacgtaccgtacgtttaaacgcgaccgacgacgtccgtcccaccccgttgactccgttccgtccccgtacccgtcccctacgttccg

SEQ ID NO: 359667 - DNA, 690 bp, Homo sapiens
  misc_feature: GZ8MTXP02I3UCA.17.33.C11.1.454.CMB.2.raw
  modified_base (233)..(233): a, c, t, g, unknown or other
  misc_feature (233)..(233): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtcccgagggaggacagtcactctcacctgtcgccttaccaacacgtggacncagtccaacctaggtctacttactactacctaaactggttaccagacaagaaccgtgaacagccgaacccgaggacctactactatttaacaacgtaaacaaaacaaacaaacaccgtaccgtccgaccctcgaccctacttctccacggtcctcccccgtcgggtacgggaacaacgtctccgacctcggacctacgtgtaccgtggggtcgtacgccacggtccgagggacggacggacggtctacgtaacttacttacgtcctacttaccgttacggttacgtttgggtagtcgtcgtggttacgtaccgttaggtccggggacggaacggtaccgaagtcgtaaccggtacgttacgttaaacgcccgaacggtacccgtaaccggtcccgtccccgtaccccgttgaccccttccggtcccttaccctaccccctccccgttactttacccg

SEQ ID NO: 359668 - DNA, 665 bp, Homo sapiens
  misc_feature: GZ8MTXP02HE5B2.17.33.C11.1.454.CMB.2.raw
  modified_base (204)..(204): a, c, t, g, unknown or other
  misc_feature (204)..(204): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttcnctggcttctcactcagaacgagtggaatgggagtgggctggactccgtcacgccccaggaacgcctggagtggcttgcgctctatttagtggatgacgagtaagcactacacgtcccgtctcgtagaaacgacacggtctacccgaccataccaaccgaacggacctaccctaccaaacctaaaccgacgggttacgtaccttaacgaacttacgaaaccctaatacgttacggacccttggacgacacgaacgaccaactattactttaacgtcgttacaccgttcgttaccgttaggtttacggggttacggggttagtttacgttaccgttcccttacgtttacgaacgttacggttacggggacccgtaggggtaaccttcggtcggtaccgtacccgttccttaccggcctaccgtccccgtacccaccggtaaccgggaccctacggttccccgg

SEQ ID NO: 359669 - DNA, 711 bp, Homo sapiens
  misc_feature: GZ8MTXP02JIIXL.17.33.C11.1.454.CMB.2.raw
  modified_base (293)..(293): a, c, t, g, unknown or other
  misc_feature (293)..(293): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtggggagtgggctggactccgtcacgacccccgaaggaaacggcccgtggagtggcttgcnctactatttagttgggatgagagtaagcactacgacgtccgtctacgtagaaagaacgaggactaccctaccataccaaccgaacggaccaaccctaccaaacaaaccgtacgggtacgtaccttaaacaaactacgaaccaaagttacgtacggtaaccctggtaacggacaaccgaacgaccccaattaaactaacgtttacgtttacgttacaacggttccttacgtttacgttggggtttaccgggattttaacgtttacgttacccgttagtttacgtacgttaccgttcgggggaccgtaaaggggtaccgtacgttccgggttaccctaacccggtccttacccggaaccgtaccgtaccccgttaccccggaacccggtaacccggtacccgtaaccggtttcccccggg

SEQ ID NO: 359670 - DNA, 533 bp, Homo sapiens
  misc_feature: GZ8MTXP02I2J2A.17.33.C11.1.454.CMB.2.raw
  modified_base (355)..(355): a, c, t, g, unknown or other
  misc_feature (355)..(355): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggatccgtcagcccccaggaaaggccctggagtggctgcgctcatttatgggatgagagtaagcactacagtccgtctctagaagaacaggctccacatcaccagacaccnccacaaaccaggtcgtcctacatcgacaatatcgacctgtgacacagccacatacttactgttcacgctctagttggtcgggatttatacgtccttattgactacgtcgggcaggggtactcgtacggtccaccgtcctacgcgtcgacctacccaccgaacggtcccacgttcccgg

SEQ ID NO: 359671 - DNA, 626 bp, Homo sapiens
  misc_feature: GZ8MTXP02G411X.17.33.C11.1.454.CMB.2.raw
  modified_base (311)..(311): a, c, t, g, unknown or other
  misc_feature (311)..(311): n is a, c, g, or t
  modified_base (363)..(363): a, c, t, g, unknown or other
  misc_feature (363)..(363): n is a, c, g, or t
  modified_base (456)..(456): a, c, t, g, unknown or other
  misc_feature (456)..(456): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtgcttccaacactggagcagtcaccagtgcttactactaccaaaactcggttccagacaagaaacctggaacaagccaaccgaggcactctaatttanaagtaaacaaaacaaacaaaactactccctacggacccctcgccgtattccncacggcctcccgtcgtggggacaagtcctcgccctgacctacgtgtcgtgggtgtgcacgcctggacggacgaggcgtagtaacttattacgntaccttacttcgttacgtttgggtcggttcgtcgttcggtcgtacgttaggttcgggacgggaacgggtacaaacggtcgtacggtaccgttacgtttaaacgccgaacgacccgaaggtcccgtccggtccccgtacggtcctaccgttccgtccgttcccctaccccg

SEQ ID NO: 359672 - DNA, 734 bp, Homo sapiens
  misc_feature: GZ8MTXP02JLHHI.17.33.C11.1.454.CMB.2.raw
  modified_base (222)..(222): a, c, t, g, unknown or other
  misc_feature (222)..(222): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagacccctcacgctcgacctgcctaccttctctggtcctttcncactcaaggaacgaggtaggaagtggggagtgggctggacctccgaccacgaccccgaaggaacgcccgtggacgtggtcgttgcctctacgtatttagtggatggaagagtaagacctaactacgtacgtccgtctacgtagaaacgaacgcggtcctacccgaacctactaaccgaaccgaaacggacccaaccctaccaaaccgtaaaccgtacgggttaccgtaacctaacgtaaactacgtaaacctaagtacgtacgacccgttggaccgaacacgacaccaaatatttaaactgttaccgttacgacccgtctttacgtagggtttacgggttacggggttaaattttaccgtttaccggttacccttacgtttacggtaccgttacggggttccggggaccgtaacgggtaccttcggtaccggttacccgacccgtttaccgcccggaactacccgtaccccgtacccgaaccggtaaccggtcccgtacccgtttcccccgg

SEQ ID NO: 359673 - DNA, 762 bp, Homo sapiens
  misc_feature: GZ8MTXP02HP1X9.17.33.C11.1.454.CMB.2.raw
  modified_base (350)..(350): a, c, t, g, unknown or other
  misc_feature (350)..(350): n is a, c, g, or t
  modified_base (552)..(552): a, c, t, g, unknown or other
  misc_feature (552)..(552): n is a, c, g, or t
  modified_base (581)..(581): a, c, t, g, unknown or other
  misc_feature (581)..(581): n is a, c, g, or t
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcgaggacgccctcactgactgtcgtcccgagggaggacagtcactctcacctgtcgtccttaccaacacgtgggacgactacgtccaccgtagtcgtacttactactaccgaaacgttcggtaccacggacaaacgtaaacccgtaggaaccaacgacctaacccggaggacctactacttaatttaanaaacgtaaaccaaaacaaaacctaaaacctaccgttaaccccggaccggtaaccccctacggtaccccgtaatttccgtaccgacggtccctccccccgtaccgggttaggggaacctaacgtccgtacgcccttagacctcgtcgtcgttggtctcggactcggtccgagggaacgtcgagtcgtacgtaactacgttacncgttacctacgttaccgttaggtttgggngttcgcgttagggtcgtacgttacggggcgggacgggaacggacctacggtaccgttaccgggtaccttacgttaaccggacaaccggtacccgtaccggtcccctccccggttcccccgaaggttcccctaaccgggtttcccctccccgttaccccccgtacccttaccccgttacccg

SEQ ID NO: 359674 - DNA, 678 bp, Homo sapiens
  misc_feature: GZ8MTXP02IZM7S.17.33.C11.1.454.CMB.2.raw
  modified_base (282)..(282): a, c, t, g, unknown or other
  misc_feature (282)..(282): n is a, c, g, or t
  modified_base (304)..(304): a, c, t, g, unknown or other
  misc_feature (304)..(304): n is a, c, g, or t
  modified_base (320)..(320): a, c, t, g, unknown or other
  misc_feature (320)..(320): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaatgggagtggctggatccgtcacgccccaggaagccctggagtggcttgcnctcatttagtggatgagagtanacactacacgtccgtntctagaagtacaggctaccaccataccaaccaacggaccaaccctaccaaccgaaaccgtggtacgttacctaacaatacgaaaccaaattacgtacggtacccgttaggacggaccaacaacgcccctaaagtacttaacttacccgttagttacccaacggtccttacgttacgggttacggggttacggggttaagtttaacggttaccggttaccctttacgttacgtaacgtacggttaccgggggacctaaacgggggtaccttaggtaccggttaccgaacccgtttccgtacccgaaccgtacgtcccccgtacccgtaaccgaaccgggtcccgtaacgtttcccccgg

SEQ ID NO: 359675 - DNA, 622 bp, Homo sapiens
  misc_feature: GZ8MTXP02F6R82.17.33.C11.1.454.CMB.2.raw
  modified_base (443)..(443): a, c, t, g, unknown or other
  misc_feature (443)..(443): n is a, c, g, or t
  modified_base (454)..(454): a, c, t, g, unknown or other
  misc_feature (454)..(454): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaagtgggagtgggctggactccgtcacgaccccaggaacgccctggagtggctgcgctctatttagtgggatgagagtaagcactacgacgtccgtctactagaaagacaggctaccaccactcaaccaacggaccacctccaaaccaaaccgtggtacgtaccttaacactacgaacccaaattacgcggaaccctggtacgacacagaccanattattacgtnttacacgtcttacgtaggttcgggtaccgggtatttaacgtttacgttacccttagtttacgaccgttacggtcggggtaccaggggtaaccttcggtacgggtccctaccgggtcctccggaacaccggccctacccgaaccgacgggtacccctacgtttccccgg

SEQ ID NO: 359676 - DNA, 712 bp, Homo sapiens
  misc_feature: GZ8MTXP02H413O.17.33.C11.1.454.CMB.2.raw
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtcccaggaggacagtcactctcacctgtgcttaccaacnctggancagtcacgagtcgacttacactaccaactggttaccagcaagaacctggaacacgcacccgaggcacgtctatttatataacaaaacaacaaaaccgtactccgtacggtaccccctgaccccgtattccaccgtacggtcccttcccccccgtaccggttaggggggaaccaaaacggtcccgttccgaccccgtcggaaccgttacgttcggttccgttggggtcggttggacccgtaacggtccgtacggaagggaaccggtaggtacgtacggtacctttaacgttaccgtacgttcccttacgttacgtttaccggtttcggggtggttcgtccgttggttacgtacgttacgggttccggggacgggtaacgggaaccgtagtcgttacggtaacccgttagttaacggaccgtacgacccggacgtccgtcccgccccgtgtcccgtacttcctaccgtcccctacccttccgtaccg

SEQ ID NO: 359677 - DNA, 705 bp, Homo sapiens
  misc_feature: GZ8MTXP02JQXLA.17.33.C11.1.454.CMB.2.raw
  modified_base (295)..(295): a, c, t, g, unknown or other
  misc_feature (295)..(295): n is a, c, g, or t
  modified_base (319)..(319): a, c, t, g, unknown or other
  misc_feature (319)..(319): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacacgacccctcacgctgacctgcctaccttctctggtcttctcactcgaagaacgaggtaggaagtgggagtgggctggactccgcacgccccgaaggaacgccgtggagtgctgcntatatttagtggatgaagagtaanacactacgtacgtcctctacgtagaacgacgacgcaccacactaccaacacgaccacctaccaaacaaaccgtacggttacgtaacttaacgaatacaaactaatacgtacgtaccgtagtacgaacacgacgaccctaaatacttaaacttaccttacgtaccacggttccttaggttacgggtttacggggttaacggtacgttttaacgtttacccgttacctttacgtttacgtaccggttaaccgggtacggggtacccggtaaagggtaaccccgttcgggtaacccggttacccgtaaccccggttccgtacccgaacgttaccccgaccccgttaaacccgaaccggaacccggtccccgttaacggtttccccccgg

SEQ ID NO: 359678 - DNA, 730 bp, Homo sapiens
  misc_feature: GZ8MTXP02HOH71.17.33.C11.1.454.CMB.2.raw
  modified_base (245)..(245): a, c, t, g, unknown or other
  misc_feature (245)..(245): n is a, c, g, or t
  modified_base (269)..(269): a, c, t, g, unknown or other
  misc_feature (269)..(269): n is a, c, g, or t
  modified_base (442)..(442): a, c, t, g, unknown or other
  misc_feature (442)..(442): n is a, c, g, or t
  modified_base (535)..(535): a, c, t, g, unknown or other
  misc_feature (535)..(535): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgctaccttctctggcttctcactcaagaacgagtggagtgggagtggntggatccgcacgcccaggacgccnggagtgctgcgtctctatttagttgggatacggagaagtaagcctaagtacgacgtccgttactctaaggaacgaacgacgggtcctacccaaccctatacccgaaacccgaaacggacccaaccctaccccgaaaaccaaaaccggtcgggttaccggttaaccccttaaanaaacgttccaaaccgtaaatacgtcggaacccccttagggacgaaccactaggacccctataactttattaaccgttgttaaccacccggttnttacgttaaggttggggttaccgggttaagttttacgttattcccccgttagtttacgaccgtttacggtacggggtacccgaaacgggttaccttaccgggttccgtacccggtaaccgtttccccggccggaacccgtccccgtaccccgtaacccggaacccggtaaccgggccccgtttaccggtcccccg

SEQ ID NO: 359679 - DNA, 594 bp, Homo sapiens
  misc_feature: GZ8MTXP02G9MDD.17.33.C11.1.454.CMB.2.raw
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (281)..(281): a, c, t, g, unknown or other
  misc_feature (281)..(281): n is a, c, g, or t
  modified_base (290)..(290): a, c, t, g, unknown or other
  misc_feature (290)..(290): n is a, c, g, or t
  modified_base (327)..(327): a, c, t, g, unknown or other
  misc_feature (327)..(327): n is a, c, g, or t
  modified_base (362)..(362): a, c, t, g, unknown or other
  misc_feature (362)..(362): n is a, c, g, or t
  modified_base (399)..(399): a, c, t, g, unknown or other
  misc_feature (399)..(399): n is a, c, g, or t
tcagcgtagactagcacgaccggtgctcgatttagagtgagctcgttgggtttgggggcgccaggggtcccttccaataccagcaccatggcctggactcctctctttctgttcctcctcacttgctgcccagggtccaattctcagactgtggtgactcaggagccctcactgactgtgtccccaggagggacagtcactctcacctgtgcttccaacnctggagcagtcaccagtncttacatccaaatgtccagcagaaactggacaagcaccaggcnctcatttanagtacaaacaacaaacactcacgccctcgccgattcncacgctccgtcccgtggggacaagcctcgccctanacgcttgcgtggtctagcgtagccgtgaggaaccggngtctagtactacttactctaccttacgttccgtttagttggtggtcgtcgttgtacgtcgttacggtcgggacgggaacggacgtacgtcgtacggtaccgttacgtacgtacgaccgaccgtacgtccgtacccgtccccgtacggtaacctaccgttccgttcccgttccccgtccctttcccgtaccgttcg

SEQ ID NO: 359680 - DNA, 686 bp, Homo sapiens
  misc_feature: GZ8MTXP02FOMYJ.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacaaacccacacacgaccctcacgctcgacctgcctaccttctctggtcttctcactcaagaacgagtagggaatggggagtgggctggactccgcacggaccccgaaggaaacggcccgtaggagtcggcttggcgtctacgtatttagttgggatgaagtagtaagcacgtacaggtccgtctctagaaacgacgacggtctaccacctactaccgaaccgaacggaccctaacctacccaaactaaacccggtagggttaccgttacctaacaaactacgaacctaaataccgtacgggtaaccctggtacgacacgacgtaccaactaattactttaaccgtgttaccgcgtactttacggttaggttcgggggttaacgggttactttaacgtttacccggttacccttagtttacgaaccgttacggtcggggtacctaaggggtaccttcggtcgtaccacccggtctccgcgaccgtcccgtaccgaccggaaccggtccacggtttccccg

SEQ ID NO: 359681 - DNA, 618 bp, Homo sapiens
  misc_feature: GZ8MTXP02FGRK1.17.33.C11.1.454.CMB.2.raw
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtgggctggactccgtcacgccccaggaaacggccctggagtggctgcgctctatttagtggatgagagtaagcactacagtccgtctcgtagaagaacnggctaccacancaccaaggaccacctccaacaaaccgaggtacgtaccttaacaatcgaaaccaatacgtcggaacctggtacggaacacgtacgacccaataattacttacgtcgtaccaacgtcttacttaggttaggggttaccggggtaagtttattacggttcccttaacgttgtaccgtaacggtcgggggaccgaacggggtaacttcggtacggtaccgtaccgtccgtccgaacgacggaccctaccgaccgaacgggccctacgttcccgg

SEQ ID NO: 359682 - DNA, 702 bp, Homo sapiens
  misc_feature: GZ8MTXP02HPH1D.17.33.C11.1.454.CMB.2.raw
  modified_base (229)..(229): a, c, t, g, unknown or other
  misc_feature (229)..(229): n is a, c, g, or t
  modified_base (687)..(687): a, c, t, g, unknown or other
  misc_feature (687)..(687): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtcccgaggaggacagtcactctcactgtcgcttccaacacgtggancagtcacctgtgtcttaactatacctaaactggtacagcaacgaaaccgtgaacacgcaccgaggacactactaatttataacgtaaacaaaacaaaccaaaacaccgtccgtaccggaccccttcgacccgtacttacctccgaacggtccccttacccccgtccgggttaacgggggacctaaacgggtctacccggtaccctcgtacctacgttcgtaccgttggggttacgcgtacgtaccgacgtacggacggaacggacggtatacggtaacttacgttaccgcgttaccttaaccgttcgtttaacggtttggttggttagtcgttacgggtgtacgttaggttccggggaagggtacggaaactacggtactacggtacctacgtttaaccgcgaacgttaaccggcgtccttcccggcccgttaacgtcctcgttccgccgtttccccncccgtttcctacccg

SEQ ID NO: 359683 - DNA, 708 bp, Homo sapiens
  misc_feature: GZ8MTXP02GDHJG.17.33.C11.1.454.CMB.2.raw
  modified_base (332)..(332): a, c, t, g, unknown or other
  misc_feature (332)..(332): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacggctggtgaaacccacacagacccctcacgctgacctgccacctttctctggcttctcactacagaacgagtggaatgggagtgggctggactccgcacgccccgaggaacgccgtggagtgcttgcgctcgtatttagtgggatggagagtaagacactacgacgtccgtntctagaagaacgacgctaccaaccgtatacgaaccgaacggaaccacctacccaaacgtaaaacccgtacgggttaccgtacctttaacgaaacttcgaaacctaagtaacgtacggtacccctaggtaccggaacacgtaacgaccctaacgtaaacttaacttaccgttacgttacccgtaacgttccttaacggttacgttacggggtttacgggggtaacgtttaacgttaccggttaacccctttacgtttaacggtaccgttaacggtcgggtaaccggtacgggtaaaccgttcgtacggtaccgtacccgtacgttaccgcgtaacccgccgtacccaaaccgtaaccgggaccctacggtttccccg

SEQ ID NO: 359684 - DNA, 653 bp, Homo sapiens
  misc_feature: GZ8MTXP02I0WIX.17.33.C11.1.454.CMB.2.raw
  modified_base (186)..(186): a, c, t, g, unknown or other
  misc_feature (186)..(186): n is a, c, g, or t
  modified_base (330)..(330): a, c, t, g, unknown or other
  misc_feature (330)..(330): n is a, c, g, or t
  modified_base (456)..(456): a, c, t, g, unknown or other
  misc_feature (456)..(456): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagacccctnacgctgacctgcaccttctctggcttctcactcagaacgagtggaatgggagtgggctggatccgtcagaccccaggaacgcccgtggagtggcttagcgctctatttagtgggatggagagtaagcactacgacgttcccgtntctagaaagaacaggctaccaccagtaccaaccgtaaggaccccactccgaacaaaccgtaggtacgtacctaacgaactgaaaccctaagtagtcgaacccttggacgaacacctaacgcctaanactactttacgtcgttacaacgtcttacgtaaggttgggtaccgggtatttacgtacgttacccgttagtttacggacttacggtacgggggtaccgtaaaggggtaccttaggtccggtaccgtacccgttcccgtacgaaccggtacccgtccgtaccccgaccgttaccggggacccctaacggtttcccccgg

SEQ ID NO: 359685 - DNA, 668 bp, Homo sapiens
  misc_feature: GZ8MTXP02F4B26.17.33.C11.1.454.CMB.2.raw
  modified_base (339)..(339): a, c, t, g, unknown or other
  misc_feature (339)..(339): n is a, c, g, or t
  modified_base (507)..(507): a, c, t, g, unknown or other
  misc_feature (507)..(507): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtcccgaggagggacagtcactctcacctgtcgcttaccaacacgtggagcacgtccaccagtcgtaccttaactactacctaaacgtggttaccaagcaagaaacctggaacaacgcaccgaggcactcatttaatagtaacaaacaacaaaaccnctacctacggacccctgccgtacttccacgtacggtcctcccccgtacggttcggggactaaacggctccgtcctgactactggtcctgggtctgcaacgtccgtaggacgggagagggtctagtacttagtactcgaccttactcgtttacgtttgggtcggttcgnttggtacgtcgttaggttcggggacgggtaaccggaagtaccgacgttaacggtaccgttacgttaacggtacgaaccggtaccgaaaccgtcccgtaccgtcccccgtggtacccttaaccgttccgtaccccttccctaccccgttacctttaacccgg

SEQ ID NO: 359686 - DNA, 587 bp, Homo sapiens
  misc_feature: GZ8MTXP02G34FX.17.33.C11.1.454.CMB.2.raw
  modified_base (185)..(185): a, c, t, g, unknown or other
  misc_feature (185)..(185): n is a, c, g, or t
  modified_base (394)..(394): a, c, t, g, unknown or other
  misc_feature (394)..(394): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggcgaaacccacacagaccctnacgctgacctgcaccttctctggcttctcactcagaacgagtggaatgggagtgggctggatccgtcacgccccaggaacgccctggagtggcttgcgctctatttagttggatggagagtaagcactacacgtccgtctcgtagaaagtaacaggctaccaccatcaccaagaccacctccgaacaaaccgtaggtacgtaccttaanaactacgaacctaaatagtcgacctgtacgacacacgaccactatacttactagttacacgtctacttagtcggttacggtagttacttacgtacccttagtttacgactacggtcgggaccgagggtaactcgtacggtcgtacccgtctaccgcgacgaccctaccgaaccgaacggcccacgttccccgg

SEQ ID NO: 359687 - DNA, 695 bp, Homo sapiens
  misc_feature: GZ8MTXP02I8Y5D.17.33.C11.1.454.CMB.2.raw
  modified_base (219)..(219): a, c, t, g, unknown or other
  misc_feature (219)..(219): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtcccaggaggacagtcactctcacctgtgcttccaacnctggagcagtccacctagtcgtcttactactacccaaacgtcggttaccagtacaacgaaaccgtggacaaggccaacccgaggcactctatttatagtaacaaacaacaaaccactccgtacgacccctcgaccgtacttctccagtccctccccgtccgttcggggacaaacggtctccgaccctggtaccacgtgtccgtagtcgtgcaacgtccgtggaacggacggtgggactacggtaaccttaagttaccgtaacgtcccttaacgttccgtttaaccgtttgggtacggtttcgcttcggttcgttaccgttggttaccggggccggggaaccgggtaccgtaaacggtcgttacgtacccgttacgtttaaacggccttaacgaccccgttaacggacccttccgggaccccttcgggtaccctaaccgtccgtttaccgtaccccctacccgtttccctttacccg

SEQ ID NO: 359688 - DNA, 656 bp, Homo sapiens
  misc_feature: GZ8MTXP02G55A0.17.33.C11.1.454.CMB.2.raw
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
  modified_base (523)..(523): a, c, t, g, unknown or other
  misc_feature (523)..(523): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacaaacccacacagaccctcacgctgacctgctaccttctctggcttctcactcagaacgagtggaagtggggagtgggctaggactccgtcacggaccccgaaggaacggccgtggagtggtctgcnctactagtttagtagggntaggagtaagtaacggacaacttacacgtcccgtctacgtagaaaacgaccaaggtcctaccgaaccctactaacccgaaaccgaacggaaccaaaccctaccaaccgtaaaaccgtacgggttacgtacctaacacgtacgtaaccaaattaccgacggtacctagacgaacacgacaaccactaattacgtacttacgtacaccggttntacgttaggtcggtacggtattacgttactaccttacgttacgacgtcggtacggaccgtaacggtcttcgtacgtcctaccgtcctaccgaacgtaccacccgaccgaaccggaccggtacctacggtcccg

SEQ ID NO: 359689 - DNA, 724 bp, Homo sapiens
  misc_feature: GZ8MTXP02GG4GA.17.33.C11.1.454.CMB.2.raw
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggcttctcactcagaacgagtggaatgggagtggctggatccgtcagccccaggaacgccctggagtggcttgcgctcattatgggatggagagtaagcactacagtcccgtctctgaaagaacaggcctaccaccgataccaaaccgaacggaaccctacccgtacccaaaccgaaaacccgtagggggttaccgttaacccttaacaaacgttacgaaaccctaaagtaacgtacgggtaacccccttgggtacggaaacaccgaacgacccaaactaacttaacttaccgtcggttaacctaccggtacttaccgtttaagggttaccggggtttacccgggggttaaaggttttactttaaccgggttaccccctttaggttttacggaacctttaccgggtcgggggtaacccgtaagggggtaaacccttcggttacggtacccgtaacccgtcttcccgcgtaccgtaccccgtacccgaacccggtacggcccctacggtttcccccgg

SEQ ID NO: 359690 - DNA, 760 bp, Homo sapiens
  misc_feature: GZ8MTXP02IODOP.17.33.C11.1.454.CMB.2.raw
  modified_base (214)..(214): a, c, t, g, unknown or other
  misc_feature (214)..(214): n is a, c, g, or t
  modified_base (525)..(525): a, c, t, g, unknown or other
  misc_feature (525)..(525): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctggcttcncactcaagaacgagtggaatggggagtgggctggactcgtcacgccccgaggaacgcctggagtggcttgcgctctagtttagtggatggtagagtaagctaactacgacgttccgtctcgtagaaacgaacgacggtccacctacctaatccaaacccgaacggaaccaacccttaccaaaccgaaaacgtacggttaccggtacctttaaacaaaacgttcgaaaaccctaaagtaaacgttcggggaaacccttggaccgacacgaacgccctaaactagtaactttaccgaggtttaccaacggttntaccgtttaggttacgggttaaccgggtaaaggttttaacttacgggttaacccccttaagtttttaccggaacctaacccggggttcgggggttaaaccccgaaaggggttaaaccttcccgggttaacggtacccccgtaaccggtttacccgcccccgggttaacgtaaccccggttaaccccgtaccccggaaaacccggtaccccggtacccgttaaaccggttccccgg

SEQ ID NO: 359691 - DNA, 694 bp, Homo sapiens
  misc_feature: GZ8MTXP02FVNP9.17.33.C11.1.454.CMB.2.raw
  modified_base (228)..(228): a, c, t, g, unknown or other
  misc_feature (228)..(228): n is a, c, g, or t
  modified_base (631)..(631): a, c, t, g, unknown or other
  misc_feature (631)..(631): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcacctgtgcttccaacacgtggancgagtccaccagtcgtcttactactaccaaacgtcggttacaagtcaaacgtaaaccgtaggaaccaacgaccgaaccccgacgggacaccgttactaattttaaactaagtaaaaccaaaaacaaaacctaaaaccacctccgtacggacccctcgacccgttacttccgtacaacgtcctccccccgttaccggtacggggacaaacggtctcgtccctgacacgttggtctagggtcgtgcacgtcgaggaggacgcgtctcgaacgttactacgtcgtaccttacgtcgtttacggtttggtcggtcgtacgtggttacgtcgttacggttaccggcgggaacggaccgtaacgtccgtacggtaccgttacgtaacgtaccgacggaccgacggtccncccgtccccggtaaccgtacctaccggtaccttcccggtacccctacccgttccgttaacccg

SEQ ID NO: 359692 - DNA, 843 bp, Homo sapiens
  misc_feature: GZ8MTXP02J26C5.17.33.C11.1.454.CMB.2.raw
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactggtggtgactcaggacgccctcactgactgtcgtccccgagggaggacagtcactctcacctgtcgccttaccaacacgtggacgcacgtaccacctaggtcgtacctttaacctactaacccgtaaacgttcggttaccacgtaccgaaacggtaaaaccccgtggaaaccgaacgaccccgaaaccccggtagggacctaaccttctaaattttaagtaaaccgtaaaaccaaaaaacccaaaacctaaaaccaccccttacccgtaccggtaaccccctcggacccccgttattcccgaccgtaccccggtcccccttccggttcccggggttacggggaactaaccggtcctccggtccctagtaccctgttcgtcggtttcggtacgggtcgtaccggacgttccggagggaaccgggaacggtcggtacgtacgtttaacgttacctttaaccggtccttaccgtttaccgtttacggttacggggtttggttcgggtacgtttccggttgttcggtaccggttacgggtttccgggggaaccggggtaaccgggaaccgtacgggtccgttacccggttaaccgtacggttaaaccgtccaaaccggcccggtaaccggtcccgtcccccggtccccgtccgtacccgttccgtttccccgttccccggtccccttcccccg

SEQ ID NO: 359693 - DNA, 608 bp, Homo sapiens
  misc_feature: GZ8MTXP02FHBAC.17.33.C11.1.454.CMB.2.raw
  modified_base (337)..(337): a, c, t, g, unknown or other
  misc_feature (337)..(337): n is a, c, g, or t
tcagcgtagactagcacgaccggtgctcgatttagagtgagctcgttggggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtggggctggatccgtcacgccccaggaaacggcccgtggagtggctgcgctctatttagttgggatggagagtaagcactacagtccgtctctagaanaacaggctccaccatcaaccaaacggaccaccctaccaacaaaacccgagggtacgtaccttaacaaactagaaccctaaatactacgggtaacccttggacggaaacaccgaagacccacaattattactggtaccacgtctctagttgggtacggggtatttacttacgtcccttagttacgactacgtcgggggaccaggggtactcgtacgtccgaaccgtctacccggcacgaccctacccaaccgaacgggaccccacgttcccg

SEQ ID NO: 359694 - DNA, 630 bp, Homo sapiens
  misc_feature: GZ8MTXP02I87YN.17.33.C11.1.454.CMB.2.raw
  modified_base (147)..(147): a, c, t, g, unknown or other
  misc_feature (147)..(147): n is a, c, g, or t
  modified_base (262)..(262): a, c, t, g, unknown or other
  misc_feature (262)..(262): n is a, c, g, or t
  modified_base (272)..(272): a, c, t, g, unknown or other
  misc_feature (272)..(272): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcacttgaaggngtctggtcctacgctggtgaaacccacacagaccctcacgctgacctgcaccttctctggcttctcactcagaacgagtggaatgggagtggctggatcgcacgcccagaagccngagtgctgcnctcattatgggatgagtagtagactactacacgtccgtctctacgaaagaacaggtacctaccaccatccaaaccgaacgaccacctaccgaacaaaccgaggtacgtaccttaacagtacgaaccaatacgtgacccttggagaactacngaccanagttntactcgttacactcgtactagttccgggtagggtatttagttaccgtcccgtttaattacgacgttaacggtcggggaacccgttaaggggtaaccttcggtaacgggttccctaaccccggtttaccggtcctaacccggaacttcccccgaaaccggttacccgaaacccggggtcccttaaccgtttccccgg

SEQ ID NO: 359695 - DNA, 790 bp, Homo sapiens
  misc_feature: GZ8MTXP02F6VQ7.17.33.C11.1.454.CMB.2.raw
  modified_base (530)..(530): a, c, t, g, unknown or other
  misc_feature (530)..(530): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacacgaccctcacgctcgacctgcctaccttctctgtccttctcactcagaacgagtaggaagtgggagtggctggactccgcaccgaccccgaggacgccgtggagtggcttgcgtctacgtagtttagtagggtataggaagtagtaacgactacgtacgtacgttccgtcgtacgtaggaaacgtaacgacggtacctaccccaccgtacctaccgaaacccgaaaccggtaaccccctaccccgtacccgaaacccaaacccggttaacgggttcccgttaaacccttaaacgaaccgttaacggaaaacccttaagttacggtaccgtaacccgttggaaccgaaacnccgtaacgaccctaactaaacttactttaccgttcgtaaaccgtacgttaccgttacgtttacggggttaccggggtttaacggggttacttttaacgttacccggtttacctttaggtttacggtaaccgttacggggtaccggggtaacccgtttaaagggtacccttcgggttaccggtaccgtacccgtcccgtcccggtaaccgcccgttaacccgtacccccgaccggtaccggtcccgttacgtttcccccgg

SEQ ID NO: 359696 - DNA, 630 bp, Homo sapiens
  misc_feature: GZ8MTXP02GT77A.17.33.C11.1.454.CMB.2.raw
  modified_base (175)..(175): a, c, t, g, unknown or other
  misc_feature (175)..(175): n is a, c, g, or t
  modified_base (204)..(204): a, c, t, g, unknown or other
  misc_feature (204)..(204): n is a, c, g, or t
  modified_base (326)..(326): a, c, t, g, unknown or other
  misc_feature (326)..(326): n is a, c, g, or t
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccanacagaccctcacgctgacctgcaccttcnctggcttctcactcagaacgagtggaatgggagtgggctggatccgtgagccccaggaaggccctggagtcggcttgcgcgtacatttattgggatgaagtagtaagcatacacgtcccgtntcgtagaaacaacgaggcctccaccgatacaaccaaagaccacctccaacaaaaccctaggtcgtaaccctagaaatcgaaccataacngtaacccgngtacgacacacgacctaatattacttactcgtacacgtctacgtacgtcgggttacggtacgtttagttaccgttacccgttagttacgtaacgttacggtacgggtaccggtaaacgggtaccgttacggtaccgttacccgtaccgtccgttccggaacgacccgtcccgtacccgaccgaacccgggtccgtaaccgttccgg

SEQ ID NO: 359697 - DNA, 778 bp, Homo sapiens
  misc_feature: GZ8MTXP02HNYK2.17.33.C11.1.454.CMB.2.raw
  modified_base (174)..(174): a, c, t, g, unknown or other
  misc_feature (174)..(174): n is a, c, g, or t
  modified_base (185)..(185): a, c, t, g, unknown or other
  misc_feature (185)..(185): n is a, c, g, or t
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctagctggtgaaacccanacagacccctnacgctgacctgcaccttctctggcttcncactcaagaacgagtggaatgggatgggntggatccgcacgccccaggaacgccctggagtggctgcgctctattagtggatggagacgtaagcgactacgagtccgtattcgagaacgaacacggtctaccgaacctataccaaaccgaaaggtacccaaacccttacccgaaaccgaaaaccgtacgggttaccggttaacccctttaacgaaaacggttaccaaaccctaaaagttaaccggttacggaacccccggtttaggtaacgggtaacccaaaccgttaacggtaaaccccaaacggtaaaacgtttaaccgttaaaccttttacgggttaccaccgggtacctttaaccgtttaacgggttacggggttaccgggggttaaaccttttaaggtttaaccggttaacccccgtttacgttttaaccgaaaccggtttacggttaaccggggacccggttaaacgggggtaaacccctggttaacgtccgtaaacccgttcgtaacccgcgacggttacccctactaaccggaaccgggccctaacgtttcccccgg

SEQ ID NO: 359698 - DNA, 699 bp, Homo sapiens
  misc_feature: GZ8MTXP02JEBP8.17.33.C11.1.454.CMB.2.raw
  modified_base (216)..(216): a, c, t, g, unknown or other
  misc_feature (216)..(216): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgccaccttctctggcttcncactcagaacgagtggaagtggggagtgggctggactaccgtcgacgcccgaggaacgccgtggagtgctgcgctctagttagtggatgagagtacgctactacacgtccgtactacgtagaacgtaacacggactaccaccagtaccaaccgaacggacccacccgtaccgaaaccgtaaaccgtggttaccgtacccttaaacaacgtacgaaaccctaagtacgtaccggtaacccttgggaacggaccaacggaccgacctaactaagttacgttacgtcggttaccacggttcttacgttagggttccgggttacggggtaatttacgttaccgttaccttacgttagaccgttacggtcggggtacccgagggttaaaccgttcgttccgggtacccgtaccggttcccctccggtaacccgtaccggtaccccgtacccggaaaccggtacccggtacccgttaccggttccccgg

SEQ ID NO: 359699 - DNA, 673 bp, Homo sapiens
  misc_feature: GZ8MTXP02JNWU3.17.33.C11.1.454.CMB.2.raw
  modified_base (231)..(231): a, c, t, g, unknown or other
  misc_feature (231)..(231): n is a, c, g, or t
  modified_base (354)..(354): a, c, t, g, unknown or other
  misc_feature (354)..(354): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccgagggagggacagtcactctcacctgtcgcttccaacactgggancagtccactagtgtacttactactacctaaacgtggttccagacaacgaaacctggaacaagccacccgagggacactactatttataagtaacaaaacaacaaaacactacctcggaccccncgcccgtacttctacacggtcctccccccgtccggttcgggggaccaaacgtcctcgacccgtcgacctacgttcggttccgtggtgtcgacgacgtcccgtaggacgggacggaggcgtagaccttacttaaccgtcgtacctaccttcgttaccggtttgggtcgttcgcgtttcggtcgttcgttaacgttcggggacggggtaacgggaccgaacggtacgtcggtaaccgttacgttaacgaccgtacgacccgtacgcccgtccggccccgttcggccctaccttcgtccgtacccctccctccgtttacccg

SEQ ID NO: 359700 - DNA, 626 bp, Homo sapiens
  misc_feature: GZ8MTXP02H5IHD.17.33.C11.1.454.CMB.2.raw
  modified_base (411)..(411): a, c, t, g, unknown or other
  misc_feature (411)..(411): n is a, c, g, or t
  modified_base (428)..(428): a, c, t, g, unknown or other
  misc_feature (428)..(428): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttccaaacactggagcagtcaccagtgcttactactacaaacttggtccagacagaaacctggaacaagcaacccaggcactctatttataacgtaacaaaacaacaaaacactcctagacctctgccgattctcgacgtccctcccttccgttacggggactaaacgcgttacgccctagacacttcgtctggtntgcacgctacgaggacnggctagacttacactcgacctactcgttaacgtttcgggttgtcgtcgtgtacgtcttagttcgggacgggaaggaccgaagcgttacggaccgttacgttaaacgttccggaacgttacccgaacggtccgtcccggcccccgttccggtaccgtaccgttccgtcccggtttaacccccgtcccctttacccccgg

SEQ ID NO: 359701 - DNA, 633 bp, Homo sapiens
  misc_feature: GZ8MTXP02FUY8M.17.33.C11.1.454.CMB.2.raw
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
  modified_base (269)..(269): a, c, t, g, unknown or other
  misc_feature (269)..(269): n is a, c, g, or t
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (342)..(342): a, c, t, g, unknown or other
  misc_feature (342)..(342): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacnctggagcagtcaccagtncttactatccaaatggttccagcagaaccnggacaagcaccaggcactcatttanagtacaaaacaanaaaaccactcctacggacccctgccccgatttccncacggcctccccctcgttggggacaagctacgcctgcactgtccgtggtgtgcacgcctaggacgggtacgagggcttaggaccttaagttacgtcgacccttacttacgttaccgtttgggtccggttgtccgttgggtgtacccgttaaggttccgggcggggaacggtaccgaaggtcgtacggtaccgttacttaaacggtccaacggtaccccgaaggtcccgtccgtacccccgtaacggtcctaaccgttccgtccccgttaccccacccccttccgttacccg

SEQ ID NO: 359702 - DNA, 574 bp, Homo sapiens
  misc_feature: GZ8MTXP02GDLE2.17.33.C11.1.454.CMB.2.raw
  modified_base (317)..(317): a, c, t, g, unknown or other
  misc_feature (317)..(317): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (384)..(384): a, c, t, g, unknown or other
  misc_feature (384)..(384): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtggggctgggactaccggtcacgaccccgaggaaacggccctggagtggcttgcgctcgatttagtgggatgagagtancatacagtcctctnagaaananaggctcacanacacaagacactcaacaaacaggtacgtccttaanaatgaaccaaatagacgaacctgtagacacganacctanatacttactntacacgtntacgttaggtgggttacggtattaacttacgttaccttagttacgtacgtacggtacggggacgtagggtacctcggtacgtacctacccgtccaccgcgacgaccctaccgaccgaccggtcctacgtcccg

SEQ ID NO: 359703 - DNA, 601 bp, Homo sapiens
  misc_feature: GZ8MTXP01EOE60.22.12.B01.1.454.CMB.2.raw
  modified_base (434)..(434): a, c, t, g, unknown or other
  misc_feature (434)..(434): n is a, c, g, or t
tcagacatacgcgtcacgaccggtgctcgatttagtagtgtagattccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagtctccaccaataagagttactagctggtccagcaagaaaccaggacatcgtcctgcactgctctatttacgtgggcgttaccgtacccgggaactcccgggggtccctacgacccccgtattcgagtcggcaacggcgggtcgtgggacagtactttcgactctacacctatcagcacgcctgcaggctagaacntgtggacttagttttatagttcgacagtactaattattacttattccctcctgaacggttaccggttaccgggaaccgttaaagggggtaccctaaagggttacgggttaaaacttaccggaaaacgtacgtaaggttcgggacttacggaaccttaacccgttaag

SEQ ID NO: 359704 - DNA, 498 bp, Homo sapiens
  misc_feature: GZ8MTXP01CZ0DV.22.12.B01.1.454.CMB.2.raw
  modified_base (200)..(200): a, c, t, g, unknown or other
  misc_feature (200)..(200): n is a, c, g, or t
  modified_base (255)..(256): a, c, t, g, unknown or other
  misc_feature (255)..(256): n is a, c, g, or t
  modified_base (315)..(315): a, c, t, g, unknown or other
  misc_feature (315)..(315): n is a, c, g, or t
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
  modified_base (363)..(363): a, c, t, g, unknown or other
  misc_feature (363)..(363): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (482)..(482): a, c, t, g, unknown or other
  misc_feature (482)..(482): n is a, c, g, or t
tcagacatacgcgtcacgaccggtgctcgatttagtagtgtagatttggggttcgggggcaggagtcagacccagtcaggacacagcatggacatgagggtccccgctcagctcctggggctcctgctgctctggctccaggtgccaaatgtgacatccagatgacccagtctccttccacctgtctgcatctgtagganacagagttaccatcacgttgccggcagtcagagtatagtgtctgggtgctggtannagcaagaaacagggaaacgccctaaggtcctgatctatgagacatactaatttaaaacnggtataccatcaagttccagcgnagtgaatcgnggacagattcactcncnccatngacncncncacncgctnatntatactatacgtacttatactacacatatatatagtagtacggtcgtcgaacgaagacgagagtaagtaacgaacgttacgttagtgcgtcncacttactcgttcgtc

SEQ ID NO: 359705 - DNA, 534 bp, Homo sapiens
  misc_feature: GZ8MTXP01CGKGN.10.80.H03.1.454.CMB.2.raw
  modified_base (315)..(315): a, c, t, g, unknown or other
  misc_feature (315)..(315): n is a, c, g, or t
  modified_base (358)..(358): a, c, t, g, unknown or other
  misc_feature (358)..(358): n is a, c, g, or t
tcagcatagtagtgcacgaccggtgctcgatttagctgtgcgtcgaagggaagggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacatcattgaaagtgaagctgtccactggtaccagcagaggccaggccaggccccctgtactggtcctctatgatgatagtgacccggccctnagggatccctgagccgattctctggctccaactctgggaaacncggccaccctgaccatcacagggtcgaagccggggatggagccgactattatgtcaggtggtggttatttcgagttagtattcgagttccgggggtttcggcgggtagggaccaaggctgaccgtcttagggtcagcccgaggctcgccccctggtcacgttctcgttcccgcccc

SEQ ID NO: 359706 - DNA, 599 bp, Homo sapiens
  misc_feature: GZ8MTXP01DNHLF.10.80.H03.1.454.CMB.2.raw
tcagcatagtagtgcacgaccggtgctcgatttagctgtgcgtcgaagggaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgacccggccctgagggactcccgtgacgccgattctcgtggcctacccaacttccgtaggggaaaccacgggcccacccgtgacccatccaccgagggtcgaaggccggggatcggacggccgaacttagttagttgtacgtagggttgggttaggttagtttcgaaggttagttagttcgaggtttcccgggggttttcggcgggtagggacccaaggtctcggacccgttcgttagggtcacgcccgacggcctcgcccccgtcggtccaccttccgttcgttcccctaacccc

SEQ ID NO: 359707 - DNA, 596 bp, Homo sapiens
  misc_feature: GZ8MTXP01AR4FB.10.80.H03.1.454.CMB.2.raw
  modified_base (225)..(225): a, c, t, g, unknown or other
  misc_feature (225)..(225): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataacctggtgggganacagcattgaaagtgaagctgtccactggtaccagcagaggccaggccaggcccctgtactggtcctctatgatgatagtcgacccgcctcgaggctccctgacgccgattctcgtggcctaccaactcgagggaaccacggcccaccctgaccatccaccgaggggtcgaaggccggggatcggacgggaccgtacttagttagttgtacgtagggttggttggttatttcgagttagtagttcgaggtttccggggggtttcgcgggtacgggacccaaggtctcggacccgtcgttacggtccacggccccgaagggccctccgggccccccttgggtcccaccgttccttccgttccccctaacccc

SEQ ID NO: 359708 - DNA, 558 bp, Homo sapiens
  misc_feature: GZ8MTXP01D8VVO.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtggggagacagcattgaaagtgaagctgtccactggtaccagcagaggccaggccaggcccctgtactggtcctctatgatgatagtcgacccggccctcgagggactccctgacgccgattctcgtcggcctacccaaactcgtagggaaaccaccgggcccaccctgaccatccaccgagggtcgaagccgggatggacgcgactattatgtcaggtggtggtatttcagttagtattcgtaggttcccgggggtttcggcgggtagggaccaaggcgtcggaccgtccgaggtcacgcccgaggcctcgcccctcggtcacttctcgttcccctaaccc

SEQ ID NO: 359709 - DNA, 558 bp, Homo sapiens
  misc_feature: GZ8MTXP01EIZSR.10.80.H03.1.454.CMB.2.raw
  modified_base (293)..(293): a, c, t, g, unknown or other
  misc_feature (293)..(293): n is a, c, g, or t
  modified_base (542)..(542): a, c, t, g, unknown or other
  misc_feature (542)..(542): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattagaaagtgaagctgtccactggtaccagcagaggccaggccaggcccctgtactggtcctntatgatgatagtgacccggcctgagggactcccgtgagccgattctctggcctacccaaactcgtaggggaaaccaccgggcccaccccgtgaccatccaaccgagggtacgaaaggccggggatagggaacgggccctaattaattattggtacgagggttgggtggttatttcgagttagtattcgagttccgggggtttgcggaggacaagctgaccgtcttaggcagccgaggctcgcccctgcncttctcgttcccgccc

SEQ ID NO: 359710 - DNA, 544 bp, Homo sapiens
  misc_feature: GZ8MTXP01AN4LV.10.80.H03.1.454.CMB.2.raw
  modified_base (224)..(224): a, c, t, g, unknown or other
  misc_feature (224)..(224): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtggggganacagcattgaaagtgaagctgtccactggtaccagcagaggccaggccaggcccctgtactggtcctctatgatgatagtgacccggccctgagggactcccgtgagccgattctctggctccaactctggggaaacacggccaccctgaccatcacgaggtcgaagccgggatggagccgactattattgtacaggtggtggtattcagtagtattcgaggttccgggggtttcgcgggtagggccaaggctcggttacccgtcttacggtcagcccgaaggcctcgcccctcggtcacttcctcgttccccaaccccg

SEQ ID NO: 359711 - DNA, 639 bp, Homo sapiens
  misc_feature: GZ8MTXP01B6QZS.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccagggataaccgtggtgggggagacagcattgaaagtgaagctgtccactggtaccagcagaggccaggccaggcccctgtactggtcctctatgatgatagtcgacccggccctcgagggactcccgtgacgccgtattctcgtcggcctacccaactcgtaggggaaaccaccgggcccacccgtgacccatccgaccgacgggtcgaaaggcccggggatacgggacggccgaacttattagttggtacgtagggttgggtggttatttcgaggttagttattcgtacggtttccggggggttttcggcgggtacggggacccaaggtccgtggacccggttccgttagggtaccacgggccccgaagggttcccgttccggcccccccgttgggtccctaccggttcccttcccggtttcccccgtccccc

SEQ ID NO: 359712 - DNA, 753 bp, Homo sapiens
  misc_feature: GZ8MTXP01EWK2E.10.80.H03.1.454.CMB.2.raw
  modified_base (228)..(228): a, c, t, g, unknown or other
  misc_feature (228)..(228): n is a, c, g, or t
  modified_base (354)..(354): a, c, t, g, unknown or other
  misc_feature (354)..(354): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagcccaccctcggtgtcagtcggccccaggagagacggccaggataaccgtggtggggganacagcattgaaagtgaagctgtccacgtggtaccagcagacggccaggccacggcccctgtacctggtcctctatgatgataggtcgacccggccctacgagggtactcccgtgacgccgtattcncgtcggccctaacccaaacgtcgtaggggaaacccacccgggccccaaccccgtcggaaaccctactacccgaacccggtaacgggggtaccggaaacgggccccgggggtaagtacggggaaccgggtacccgtaacgtttaagtttaacgttacggtacgtaaggggtttgggggtttaggggttttaaattttaccgaagggtttaagttaacgtttcggttaacggggttttcccggggggggttttcggaccgggggtaacggggtaacccgaaagggtccgtacggttaaccccggttcggttaacgggtaccgaccggacccgttaacgggcccgttcccggccccccgttcgggtaccctacccgttccttcccgttcccccctaaccccg

SEQ ID NO: 359713 - DNA, 667 bp, Homo sapiens
  misc_feature: GZ8MTXP01BBRVL.10.80.H03.1.454.CMB.2.raw
  modified_base (225)..(225): a, c, t, g, unknown or other
  misc_feature (225)..(225): n is a, c, g, or t
  modified_base (372)..(372): a, c, t, g, unknown or other
  misc_feature (372)..(372): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtggggganacagcattgaaagtgaagctgtccactggtaccagcagacggccaggccaggccccctgtactggtcctctatgatgatagtgacccgcctgaggactccctgacgccgattctcgtcggccttaacccaacttcgacgggaaaccnccgggaccccacccgtcgaacccatacccgaaccgaggggtaccgaaaggcccgggggaatacgggacggtaccgtaacttagttacttggtacgtagggttggtacgggttaattttcgaaggttagttaagtttccgtaagggttttacccgggggggttttcgaccgggggtaaggtaacccaagggtccttacgggacccgttccgttagggtccgaacggccccgaagggcccttcccggcccccccgttcgggttcccaccttcccgttccgtttcccccctaaccccc

SEQ ID NO: 359714 - DNA, 729 bp, Homo sapiens
  misc_feature: GZ8MTXP01AWJK7.10.80.H03.1.454.CMB.2.raw
  modified_base (225)..(225): a, c, t, g, unknown or other
  misc_feature (225)..(225): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtggggganacagcattgaaagtgaagctgtccactggtaccagcagaggccaggccaggcccctgtactggtcctctatgatgatagtcgacccggccctgagggtactcccgtgacgcccgtatttctcgtcggcctacccaaactccgtaggggaaacccaccgggccccaaccccgtggaacccctactccgaacccgtacggggtaccggaacgggacccgggggatacgggacgggacccgtaacgttaagttacgttggtacgtaagggttgggttagggttaagttttacgaaggtttaagttaacgtttcgtaacgggtttcccggggggttttcggggacgggtaacggggtaacccgaaaggtccggttacggttacccggttacccgttacgggttacccgaacggaccccgttaaacgggttcccgttcccgggtccccccccgttcggggttaccccgtaaccgttcccctttaaccgggtttccccccgtaacccccg

SEQ ID NO: 359715 - DNA, 715 bp, Homo sapiens
  misc_feature: GZ8MTXP01AESKV.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtggggagacagcattgaaagtgaagctgtccactggtaccagcagaggccaggccaggcccctgtactggtcctctatgatgataggtgacccgggccctgagggtactcccgtgacgccgattctcgtcggcctacccgaaactcgtacggggaaaccacgggccccaccccgtgacccactccaaccgagggggtaccgaaacgggcccgggggaatacgggacgggccgtaacgttaagtttagttcggtacgtaaggggttgggttaggggtttaattttccggaaaggtttaacgttagtttccggtaacgggttttcccggggggggtttttccggacggggtaacgggggtacccaaagggtccgttcgggttacccggttaccccggttaaggggttcccgaacgggaccccgaaacgggttcccgttcccggtcccccccgttcggggttccccaccgtttcccttcccggtttccccccgttccccccg

SEQ ID NO: 359716 - DNA, 740 bp, Homo sapiens
  misc_feature: GZ8MTXP01DS9DU.10.80.H03.1.454.CMB.2.raw
  modified_base (233)..(233): a, c, t, g, unknown or other
  misc_feature (233)..(233): n is a, c, g, or t
  modified_base (311)..(311): a, c, t, g, unknown or other
  misc_feature (311)..(311): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgccgacctcctatgtgctgtctcacgcccacccgtcggtgtcaggtcggccccgaggagaggacggccaggactaacgtggtgggganacagcattagaaagtgaagctgccagtcggtaccagcgaggacggccgacggccgacggcccctgtacgtcggtcctntatgatgagtacggtcgaccccggccctcggagggtacctcccgtgacgtccgtacttctcgtcggccctaaacccgtaacgtccggtaacggggaaacccacccgggaccccctacccgtacgaaccctactacccgaacccgggtaacggggtaccggaacggggcccgggggtaatacggggaacgggtcccgtaattagttacgttggtacgtagggttggggttaggtttagtttacgtaagttaggttactttcgggtaacgggtttcccggggggttttacgggaccggggtaacggggtaaccgaacgggtccgtaccggttacccggttaccgttacgggtacgaccggacccgaacggttcccgtaacccggtcccccgttcggtaccctccgttccttcccggttcccctaacccccg

SEQ ID NO: 359717 - DNA, 550 bp, Homo sapiens
  misc_feature: GZ8MTXP01EAWF8.10.80.H03.1.454.CMB.2.raw
  modified_base (225)..(225): a, c, t, g, unknown or other
  misc_feature (225)..(225): n is a, c, g, or t
  modified_base (439)..(439): a, c, t, g, unknown or other
  misc_feature (439)..(439): n is a, c, g, or t
  modified_base (479)..(479): a, c, t, g, unknown or other
  misc_feature (479)..(479): n is a, c, g, or t
tcagcatagtagtgcacgaccggtgctcgatttagctgtgcgtcgaagggaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataaccgtggtggggganacagcattagaaagtgaagctgtccacgtggtaccagcagaggccaggccaggcccctgtactggtcctctatgatgaataggtcgacccggtccctcgagggactcccgtgacgtccgtattctcgtggcccttaaccaaactcgtagggaaccaccggcccaccctgaccatcacgagggtcgaaggccgggatcgaggccatatatgtacnggtgtgttattcagtagtatcgtaggttccgggggtttgnggacggaccaaggcgtgccgtcgttaggtcacgccgagcctcgcccctggtcacttcgtccgttccctccc

SEQ ID NO: 359718 - DNA, 683 bp, Homo sapiens
  misc_feature: GZ8MTXP01A70DW.10.80.H03.1.454.CMB.2.raw
  modified_base (227)..(227): a, c, t, g, unknown or other
  misc_feature (227)..(227): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataaccgtggtggggganacagcattgaaagtgaagctgtccacgtggtaccagcagacggccaggccaggcccctgtactggtcctctatgatgatgtcgacccggccctgaggactcccgtgacgcccgtattcgtcgtcggccctaacccaacgttccggtaacgggaaacccacccgggcccctaaccccgtgaaccccaactacccgaacccgaacggggtacgaaacgggcccggggaagtacgggaacgggacccgtaacgttagttacgttggtacgtagggttaggggttagggtttaatttcgaaaggtttagttagttccgttacgggtttcccggggggttttcggacggggtaacgggaaccgtaaggtccgtacggacccgtcgttacgggtaccacggacccgaacggttcccgtccgcccccgttaacgccgtaccttccgtccgttccccgtccccg

SEQ ID NO: 359719 - DNA, 730 bp, Homo sapiens
  misc_feature: GZ8MTXP01EFGMR.10.80.H03.1.454.CMB.2.raw
  modified_base (227)..(227): a, c, t, g, unknown or other
  misc_feature (227)..(227): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataaccgtggtggggganacagcattagaaagtgaagctgccactggtaccagcagacggccaggccaggcccctgtactggtcctctatgatgatagtcgacccggccctgaggactcccgtgacgtccgtattctcgtggcctaacccaaactcgtacgggaaacccacccgggacccctaaccccgtcggaaccctaacgtacccgaaaccgacgggggtaccggaaacgggcccgggggaagttacgggacgggtacccgtaacgttagttaacgttggtacgtaagggttgggttagggtttaacgtttacgaaggttaagttacgtttaccggtaacgggtttcccgggggggttttacggacgggggtaacggggtaaccccgtaaagggtcgttaccgggttaacccggttccgttaacgggtaccgtaaccggaccccgaaacggggttcccgtcccggtccccccggttcgggtaccctaccgttcccgttccggttccccctaacccccg

SEQ ID NO: 359720 - DNA, 725 bp, Homo sapiens
  misc_feature: GZ8MTXP01EU74F.10.80.H03.1.454.CMB.2.raw
  modified_base (227)..(227): a, c, t, g, unknown or other
  misc_feature (227)..(227): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataaccgtggtggggganacagcattagaaagtgaagctgtccactggtaccagcagacggccaggccacggcccctgtactggtcctctatgatgatagtcgacccgcctgagggactcccgtgacgtccgatttcgtcgtcggacctaacccgaaacttcgtacgggaaaccacccgggccccaacccgtggaaccctaacttaccgaacccggtagggggtacgaaacgggcccgggggaagttacgggacgggtacccgtattaagttacgttcgtacgtagggtttgggttagggtttaactttcgtagttagttaatttccggtaaggtttcccggggggggttttacgacggggtaacggggtacccaaagggtccgttacggttaaccccggttccgttaacgggtaccgaaccgggacccccgaaggggttccccgttccgggaccccccccgttaaggggttcccctacccggttccgtttccccgttttcccccgtaaccccccg

SEQ ID NO: 359721 - DNA, 718 bp, Homo sapiens
  misc_feature: GZ8MTXP01E0CCI.10.80.H03.1.454.CMB.2.raw
  modified_base (226)..(226): a, c, t, g, unknown or other
  misc_feature (226)..(226): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataaccgtggtggggganacagcattagaaagtgaagctgtccactggtaccagcagaggccaggccaggcccctgtactggtcctctatgatgatagtgacccggcctgaggactcccgtgacgccgtattctcgtcggcctaacccgaaactcgtacggggaaacccaccgggcccacccgtgaaccctacgtaccaacccggaaggggtaccggaaacgggcccgggggatacgggaacgggtacccgtaacgttaagttacgttggtacgtaaggggttggggttagggtttaatttccgtaaggttaagttaacgtttcgtaacgggtttcccgggggggtttttcgggacggggtaacggggtacccgtaaacgggtccgttacggttaaacccgggttcccgttaacggggtacccgaacgggccccgaaacgggttccccgtcccggtccccccgttcggggtaccctacccgttcccgtttcccggtttcccccgtccccc

SEQ ID NO: 359722 - DNA, 575 bp, Homo sapiens
  misc_feature: GZ8MTXP01AQGSZ.10.80.H03.1.454.CMB.2.raw
  modified_base (483)..(483): a, c, t, g, unknown or other
  misc_feature (483)..(483): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataaccgtggtgggggagacagcattgaaagtgaagctgtccactggtaccagcagaggccaggccaggccccctgtactggtcctctatgatgatagtcggacccggccctcgaggggtactcccctggacgtccgatttctcgtcggcctacccaaactccgtaggggaaaccaccgggcccacccgtgaccccagtcccaaccgaggggtacgaaggccggggatcggacggcccgatacgttatgtcgaggtggtggttattcgagtagtntcgtagttccgggggtttgcggaggccaaggctgaccgtcgttaggtcacgcccgaggcctcgcccctcggtcacgttcctcgttccctccc

SEQ ID NO: 359723 - DNA, 669 bp, Homo sapiens
  misc_feature: GZ8MTXP01ACHVQ.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataacctggtgggggagacagcattagaaagtgaagctgtccactggtaccagcagaggccaggccacggcccctgtactggtcctctatgatgatagtcgacccggccctcgaggactcccgtgacgcctattctcgtcggcctaacccaactcgtagggaaacctaccggacccacccgtgaccaagtcccgaaccgacggggtacgaaacggccgggggaatacggggaacggtcccgtaacttagttacgttcggtacgtaggggttggttagggttactttcgaaggtttagtagtttcgtaacgggtttcccggggggtttacggcggggtaacggggacctaagggtcgttacggacccggttccgttaagggtccgaacgttccccggaaacgggcccgtaacccgcccccgttcgggtctacccgttccgttcccgttaacccctaacccc

SEQ ID NO: 359724 - DNA, 749 bp, Homo sapiens
  misc_feature: GZ8MTXP01CZ70A.10.80.H03.1.454.CMB.2.raw
  modified_base (224)..(224): a, c, t, g, unknown or other
  misc_feature (224)..(224): n is a, c, g, or t
tcagcatagtagtgcacgaccggtgctcgatttagctgtgcgtcgaagggaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataacctggtgggganacagcattgaaagtgaagctgtccactggtacagcagaggccaggccaggcccctgtactggtcctctatgatgatagtcgacccggccctcgaggactcccgtgacgccgtattcgtcgtcggcctacccaaacgttcgtacggggaaaccctaaccgggccccaaccccgtcgaaccccacgtacccgaacccgaacgggggtaccggaaacgggccccgggggtaagtacgggaacgggtacccgtaacgttaagttaagtttggtaccgtaaggggtttgggttagggtttaacgtttttacgaaggtttaagttaacgtttccggtacgggtttaccccggggggggtttttcggaccgggggtaacggggtaaccccgaagggtccgttcgggaaccccgggtttccgttaacggggttaccaacgggttaccccgttaacggggttccccgttcccgggtcccccccgttcggggttccctacccggtttcccgttcccggtttccccccgtcccccg

SEQ ID NO: 359725 - DNA, 664 bp, Homo sapiens
  misc_feature: GZ8MTXP01CVSHN.10.80.H03.1.454.CMB.2.raw
  modified_base (224)..(224): a, c, t, g, unknown or other
  misc_feature (224)..(224): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctggtgtcagtcggcccaggagagacggccaggataacctggtagggganacagcattaggaaagtgaagctgtccacgtggtaccagcagacggccaggccacggcccctgtactggtcctctatgatgatagtcgaccggtcctacgagggactcccgtgacgccgtattcgtcgtcggcctaacccgaactccgtaggggaaaccacccgggacccaacccctacgaacccactaccgaaccgtacggggacgaaacgggccggggaatcgggaacgggccctaagttagttagtggtacgtaagggttgggtaggtttatttcgaggttagttaagttccgtaagggtttcccgggggtttcggcgggaacgggtaccaaggtcgtacggttaccggtcgttacgggtaccacgacccgacggttcccttccggaccccccttcggggtccctaccttcccgttcccgttaaccccctaacccccg

SEQ ID NO: 359726 - DNA, 833 bp, Homo sapiens
  misc_feature: GZ8MTXP01D8B5T.10.80.H03.1.454.CMB.2.raw
  modified_base (229)..(229): a, c, t, g, unknown or other
  misc_feature (229)..(229): n is a, c, g, or t
  modified_base (301)..(301): a, c, t, g, unknown or other
  misc_feature (301)..(301): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgccacccgtcggtgtcagtcggccccaggagagacggccaggataaccgtggtggggganacagcattagaaagtgaagctgaccacgtggaccagcgagacggccaggccacggcccctgtactggtcctntatgatgatacggtcgacccgcctacgaggtactcccgtagacgtccgtacttcgtcgtacggtacccttaacccgaacgttccggtaacggggaaacccacccgggacccccttaacccccgtacggaaaccccttaacgtacccgaaaccggtaacggggtaaccggaaacggggtaccccgggggaagttaaccgggaacgggtaccccggtaaactttaacgtttaacgttcggtacgttaaaggggtttcgggttaacggggttttaactttacggtaacggtttaaggttaaacggtttccggttaacgggggttttaaccccgggggggtttttcgggaaccgggggttaaaccgggtaacccgaaagggtccggttaaccgggttacccggttaccccggttaaagggtacccggtaacccggaccccggttaaacgggttccccgttcccgggtcccccccgttccggggtaaccctaccctttaccccggtttcccccgtttaaccccccgttaaccccccg

SEQ ID NO: 359727 - DNA, 624 bp, Homo sapiens
  misc_feature: GZ8MTXP01AO4AA.10.80.H03.1.454.CMB.2.raw
  modified_base (376)..(376): a, c, t, g, unknown or other
  misc_feature (376)..(376): n is a, c, g, or t
  modified_base (422)..(422): a, c, t, g, unknown or other
  misc_feature (422)..(422): n is a, c, g, or t
tcagcatagtagtgcacgaccggtgctcgatttagctgtgcgtcggaagggaaaggggctgggcctaaggaagcagcactggtggtgcctcagccatggcctggaccgttctcctcctcggcctcctctctcactgcacagcctctgccgacctcctatgtgctgtctcagccaccctcggtgtcagtggccccaggagagacggccaggataaccgtggtgggggagacaggcattagaaagtgaagctgtccactggtaccagcagagcaggccaggcccctgtactggtcctctatgatgatagtcgacccggccctcgagggactcccgtgacgccgtattctcgtggcctaccaacgttcgcgggaaaccncggcccaccgtgaccactccgacgagggtacgaaacggccggggancggacgtacgtaacttagttagtgtacgtaggttgggttaggttattacgagttagttacgttcggtacgggtttccgggggttacggacgggtacggtaccgacggtccgtacggttaccgtacgttacggtaccacggttcccgaggttcccgtcccgtccccgtcggtacctccgttccgtcccgttaaccccgtcccg

SEQ ID NO: 359728 - DNA, 722 bp, Homo sapiens
  misc_feature: GZ8MTXP01C35QD.10.80.H03.1.454.CMB.2.raw
  modified_base (231)..(231): a, c, t, g, unknown or other
  misc_feature (231)..(231): n is a, c, g, or t
  modified_base (305)..(305): a, c, t, g, unknown or other
  misc_feature (305)..(305): n is a, c, g, or t
tcagcatagtagtgcacgaccggtgctcgatttagctgtgcgtcgaagggaaggggctgggcctaaggaagcagcactggtggtgcctcagccatggcctggaccgttctcctcctcggcctcctctctcactgcacagcctctgcgacctcctatgtgctgtctcacgcccacccgtcggtgtcaggtcggccccaggagacgacggccaggataaccgtggtggggganacgagcattagaaagtgaagctgtccagtcggtaccagcagacggccaggccacggcccctgtactcggtcctntatgatgatagcgacccggtcctgaggtactccgtgacgccgtacttctcgtcggcctaaccgaacgtcggtacgggaaccacccgggaccccacccgtgaaccctacgtacccgaacgggacggggtaccggaaacggggtccggggtaaagtacggacgggtaccctaagttagttacgttcgggtacgtaaggggtttggtttaacgggtttactttaggtaaagggttagtttaaccgttcgggttaacggggttttcccggggggtttacgaccggggaacggggtacccctaaaggtccgttacggttacccgggttccgacgggttaccgaccgacccggttaggttcccccgttccggccccccgttaaggtccctaccgttcccgtcccgttaacccccgtaaccccg

SEQ ID NO: 359729 - DNA, 755 bp, Homo sapiens
  misc_feature: GZ8MTXP01AWDKQ.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtgggggagacagcattgaaagtgaagctgtccatggtaccagcagaggccaggccaggcccctgtactggtccctctatgatgataggtcgacccggcctcgagggatcccgtgacgtccgattctcgtggcctaaccgaactcgtaggggaaaccacgggcccaaccctgacccactccgaacccgaggggtacgaaacgggccgggggaatcgggaacgggtacccgaacgtttaattaacgtttcggtacgtaaaggggttggttaggggtttactttttaccggaaggtttaaaggttaacgtttccggtaaacgggttttccccgggggggggtttttacggaccgggggttaaggggaaccccgtaaagggtcccgttacggggttaaaccccggttacccggtttaaacggggtacccaaccggggacccccggttaaaggggttccccgttaaccccgggacccccccgtttaacgggggtcccctaacccgttcccgtttcccggtttaaccccccctttaaccccccg

SEQ ID NO: 359730 - DNA, 771 bp, Homo sapiens
  misc_feature: GZ8MTXP01DN66X.10.80.H03.1.454.CMB.2.raw
  modified_base (228)..(228): a, c, t, g, unknown or other
  misc_feature (228)..(228): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcaggtcggccccaggagagacggccaggataaccgtggtggggganacagcattagaaagtgaagctgtccactggtaccagcagaggccaggccaggccccctgtactggtcctctatgatgatagtcgacccggccctcgagggtactcccgtgacgtccgtattcgtcgtcggcctaacccgaaacttcggtacgggaaacccacccgggaccccaccccgtgaacccactacccgaaccgagggggtaccggaaacggggcccgggggaagtacgggaacgggtacccgtaacgttaagtttacgttcggtacgtaaggggttgggtttaggggtttaagtttttccgaaagggtttagttaacgtttccggtaacggggttttcccgggggggttttcgggaccgggggtaaacggggtaacccgtaaagggtcccgttacgggttaaccccggttccgttaacggggttacccgaaccgggttacccccggaaacgggttccccgttccccgggtcccccccgttaacggggttcccctaacccgtttcccgtttccccggtttcccccccgttaaccccccg

SEQ ID NO: 359731 - DNA, 722 bp, Homo sapiens
  misc_feature: GZ8MTXP01CUCVH.10.80.H03.1.454.CMB.2.raw
  modified_base (225)..(225): a, c, t, g, unknown or other
  misc_feature (225)..(225): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataacctggtgggganacagcattgaaagtgaagctgtccacgtggtaccagcagaggccaggccacggcccctgtactggtcctctatgatgatacgtcgacccgcctcgaggactccgtgacgccgtacttccgtcgtcggtaccctaacccgtaactccggtacgggaaacccgacccgggtaccccaccccgtacgaaccctaactacccgaaacccggtacggggtacggaaacggggacccgggggtaagtacgggaaccgggtacccgtaacgtttaagtttagttacggttacgtaaggggtttgggttaggggtttaacttttccggaaaggtttagtacgtttcggttaacggggtttcccggggggttttacgggacggggtaacggggaacctaagggtccgtacggacccggttaccgttacggtaccgacggacccgttagggttcccgtcccgtccccggtcgtaccctacgttccctcccggttccccctaaccccg

SEQ ID NO: 359732 - DNA, 640 bp, Homo sapiens
  misc_feature: GZ8MTXP01DYE27.10.80.H03.1.454.CMB.2.raw
  modified_base (224)..(224): a, c, t, g, unknown or other
  misc_feature (224)..(224): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtgggganacagcattgaaagtgaagctgtccactggtaccagcagaggccaggccacggcccctgtactggtcctctatgatgatagtgacccggccctgaggactccccgtgacgccgattctcgtggcctacccaaactcgtacgggaaaccaccgggcccaaccccgtgaacccactccgaaccgaggggtacgaaagggcccggggaagtacggacggaccgtactaattagttggtacgagggttggttagggttatttacgaggttagttagttcgtacggtttcccggggggttttcggacgggtacgggaacccaaggtcctacggttacccgtcgttaacgggtccgaacggccccgaagggccctccggccccccgttcgggtaccaccgttccgttccgttccccgtccccc

SEQ ID NO: 359733 - DNA, 657 bp, Homo sapiens
  misc_feature: GZ8MTXP01CFK8V.10.80.H03.1.454.CMB.2.raw
  modified_base (331)..(331): a, c, t, g, unknown or other
  misc_feature (331)..(331): n is a, c, g, or t
  modified_base (343)..(343): a, c, t, g, unknown or other
  misc_feature (343)..(343): n is a, c, g, or t
  modified_base (510)..(510): a, c, t, g, unknown or other
  misc_feature (510)..(510): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagacgacggccaggataaccgtggtgggggagacagcattgaaagtgaagctgccactggtaccagcagaggccaggccacggcccctgtactggtcctctatgatgatagcgacccgccctgagggactcccgngacgcctattcncgtggccctaacccgaacgtcgtaggggaaacccaccgggcccaacccctcggaacccactaccgaaccgacggggtaccggaacggcccggggatacgggaacgggccgtaacttagttagttgtacgtagggttgggttagggttactttacgtaggttacgttnttacgtacgggtttccggggggtttcggacggagggtacccaaggtccgtacggttacccggttcgttacggtccgtacggaccccgaggttcccgtccggcccccttcgggttcccacgttcccgttccggttcccccgtaacccc

SEQ ID NO: 359734 - DNA, 703 bp, Homo sapiens
  misc_feature: GZ8MTXP01DQNQP.10.80.H03.1.454.CMB.2.raw
  modified_base (233)..(233): a, c, t, g, unknown or other
  misc_feature (233)..(233): n is a, c, g, or t
  modified_base (304)..(304): a, c, t, g, unknown or other
  misc_feature (304)..(304): n is a, c, g, or t
tcagcatagtagtgcacgaccggtgctcgatttagctgtgcgtcgaagggaaggggctgggcctaaggaagcagcactggtggtgcctcagccatggcctggaccgttctcctcctcggcctcctctctcactgcacagcctctgcgacctcctatgtgctgtctcacgccacccgtcggtgtcaggtcggccccaggagaggaccggccaaggactaaccgtggtggggganacagcattagaaagtgaagctgtccacgtggtaccagcagacggcaggccacggcccctgtactggtcctntatgatgatgtcgacccgcctagaggtctccgtgacgtccgtattcgtcgtcggaccctaacccgaaaccgttcggtacggggaaacccacccggggacccctaaccccgtaggaaccctaactaccgaaccggaacgggggtaccggaaacggggcccggggaagtacgggaccggtaccgtaacgttagttacgttgtacgtagggttggggttaggtttattacgtaaggtttacgtacgtttcggtagggtttcccggggggtttcgggacccggggtaagggtacccgtaaggtcgttccggttacccggtcgttaacgggtacgccgttaacccggttacggccgttcccggccccgttcggtactcccgttccgttcccgttccccgtcccc

SEQ ID NO: 359735 - DNA, 647 bp, Homo sapiens
  misc_feature: GZ8MTXP01ADQL2.10.80.H03.1.454.CMB.2.raw
  modified_base (227)..(227): a, c, t, g, unknown or other
  misc_feature (227)..(227): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaaggataaccgtggtgggganacagcattagaaagtgaagctgtccactggtaccagcagaggccaggccacggcccctgtactggtcctctatgatgataggtcgacccggccctagacgggtactcccgtggacgtccgtattcgtcgtcggccttaccgaactcgtacgggaaacccacgggccccaccgtcgacctacgtcccaacgacggggtacgaaacgggccggggaatacgggacggtaccgaacgtttaagttgttacggtcgtaagggttggggttggtttaagtttcgaggttaagttacgttcgtaccgggtttccggggggtttacggcggggtacgggaccgaaggtcgtacggttaccggtcgttacggtcgacgcccgaggcctccgccccgtcggtcctacgttcgttccggttcccgtcccc

SEQ ID NO: 359736 - DNA, 705 bp, Homo sapiens
  misc_feature: GZ8MTXP01DHYQ1.10.80.H03.1.454.CMB.2.raw
  modified_base (226)..(226): a, c, t, g, unknown or other
  misc_feature (226)..(226): n is a, c, g, or t
  modified_base (333)..(333): a, c, t, g, unknown or other
  misc_feature (333)..(333): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgccaccctcggtgtcagtcggcccaggagagacggcaggataaccgtggtggggganacagcattagaaagtgaagctgccactcggtaccagcagacggccaggccacggcccctgtactggtcctctatgatgatagtcgacccggcctcgaggactcccgngacgccgtattctcgtcggcctaacccaacgtcgtacgggaaacccacccgggacccctaccccgtagaaccccacgtacccgaaccggacgggggtaccggaaacgggcccgggggtaatacggggacggtacccgtaacgttagttagttcgtacgtagggttcgggttaggttatttacgaggttagttattccggtagggtttcccggggggtttcggcggggtaacgggacccgtaagggtccgttacgggacccgttaccggttacgggtccgacggttaccccggttaacgggttcccgttcccgggtccccccgttcgggttacccctaccgttccccgttcccgttaaccccccgtaaccccc

SEQ ID NO: 359737 - DNA, 740 bp, Homo sapiens
  misc_feature: GZ8MTXP01EWFHA.10.80.H03.1.454.CMB.2.raw
  modified_base (226)..(226): a, c, t, g, unknown or other
  misc_feature (226)..(226): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataaccgtggtggggganacagcattgaaagtgaagctgtccactggtaccagcagagccaggccaggcccctgtactggtcctctatgatgaataggtcgacccggcctcgagggactcccgtgacgcccgtattctcgtggacctacccaactcgtagggaaaccaccggccccaacccgtgaaccctataccaaccgacggggtaccggaaacgggcccgggggaagtacgggaacgggtacccgaacgttaagttaacgttggtacggtaagggttcggggttaggtttacgttttacgtaaggttagttacgtttcgttaacgggtttcccggggggtttttaccgggaccggggttaacggggaacccgaaagggtccgttacgggttaaccccggttacccggttaacgggttaccggtaacccggttaccccgaaacgggttccccgtttaaccccgggcccccccgttccggggttcccctacccggttcccgttcccggttttcccccccggtaaccccccg

SEQ ID NO: 359738 - DNA, 731 bp, Homo sapiens
  misc_feature: GZ8MTXP01DXRH1.10.80.H03.1.454.CMB.2.raw
  modified_base (225)..(225): a, c, t, g, unknown or other
  misc_feature (225)..(225): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgccaccctcggtgtcagtcggcccaggagagacgccaggataaccgtggtgggganacagcattagaaagtgaagctgccactggtaccagcagacggccaggccacggcccctgtacgtcggtcctctatgatgatacggtcgacccggcctacgacggtactcccgtgacgtccgacttcgtcgtcggacctaacccaaactccggtacgggaaacccacccgggaccccaccccgtacggaaccctacgtacccgaaccggtaacggggtaccggaacgggtccggggaagtacgggtaccgggaccgtaacttaagtttagttacggtacgtagggttggttacgggtttaatttacgtaaggttagttacgtttacgtacggggtttcccggggggttttacggacggggtaacggggtaccgtaaaggtccgttacggttacccggttaccgttacgggtaccgaaccggaccccggttaacggttccccggtcccggtacccccgtccgggttaccctacccgttccgttaaccccgtttcccccgtaacccccg

SEQ ID NO: 359739 - DNA, 747 bp, Homo sapiens
  misc_feature: GZ8MTXP01DPRT4.10.80.H03.1.454.CMB.2.raw
  modified_base (227)..(227): a, c, t, g, unknown or other
  misc_feature (227)..(227): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgccaccctcggtgtcaggtcggccccaggagagacggccaggataacgtggtgggganacagcattagaaagtgaagctgtccactggtaccagcaggacggccaggcccacggcccctgtactcggtcctctatgatgagtacgtcgacccggcctcgaggactccgtgacgtccgacttcgtacgtcggtaccctaacccaaacgtccggtaacggggaaaccccgtacccgggacccccctaaccccgtacgggaacccctaaaccgttacccgaaacccggtacggggtaacccgggaacggggtacccgggggaagtacgggaaccgggtacccgtaacgtttaagttaacgttggttacgttaagggttcggggttagggtttaacgttttacgtaggtttaagtttacgttacggttaccgggtttaccggggggttttccggacggggtacgggtaccgtaaggtcgtaacggttcccgttacgttacggtaccgtacggacccgacggttccctccggtacccccgttcggtacccgtcgttcccgttcccgttaacccccgtcccccg

SEQ ID NO: 359740 - DNA, 665 bp, Homo sapiens
  misc_feature: GZ8MTXP01AK3JQ.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataaccgtggtgggggagacagcattagaaagtgaagctgtccactggtaccagcagacggccaggccacggcccctgtactggtcctctatgatgatagtcgacccggccctcgagggtactcccgtggacgtccgtacttctcgtcggtcctaacccaaacgttccgtacggggaaacccaccgggtccccaacccgtcgaacccacgtacccgaacccgacgggggtaccggaacgggcccgggggaagtcggacgggccgtaattagttagttgtacgtagggttcggttggttatttcaggttagttacgttcgtacggtttccggggggtttcggcggggtacgggtaccgtaaggtccgtcggacccggttccgttacgggtccgaccggacccgacggttccgtcccgccccgttcggtccaccgttccgttcccgttccccgtccccc

SEQ ID NO: 359741 - DNA, 730 bp, Homo sapiens
  misc_feature: GZ8MTXP01DRKNT.10.80.H03.1.454.CMB.2.raw
  modified_base (224)..(224): a, c, t, g, unknown or other
  misc_feature (224)..(224): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggcccaggagagacggcaggataacgtggtggggganacagcagttagaaagtgaagctgccactggtaccagcagaggccaggccacggcccctgtactggtcctctatgatgaataggtcgacccgggccctacgacgggactcccgtggacgtcccgtattcgtcgtcggccctaacccgaaacttcggtaacgggggaaacccacccggggacccctaaccccgtcggaaccctaactacccgaaacccggtaacgggggtaccggaaacggggacccgggggtaagtacgggaacgggtaccgtaaccgttaagttagttggtacgtaaggggttggggttagggtttaatttcgtaaggttaagttacgttcgtaacggggtttcccggggggttttacgggacggggtaacggggaaccgtaaagggtccgttacgggaacccggttccggttacggtaccgtaccggacccgaacgggttccgtccggtccccccgtcgggtccctaccgttccgttcccgtttccccgtccccc

SEQ ID NO: 359742 - DNA, 741 bp, Homo sapiens
  misc_feature: GZ8MTXP01AD4MZ.10.80.H03.1.454.CMB.2.raw
  modified_base (224)..(224): a, c, t, g, unknown or other
  misc_feature (224)..(224): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacgcaggataaccgtggtgggganacagcattagaaagtgaagctgtccacgtggtaccagcaggacggcacggccacggcccctgtactcggtcctcgtatgatgatacggtcgacccggcctcgaggactcccgtggacgccgtacttcgtcgtcggacctaacccgaaacgttccggtacggggaaacccgacccggggtaccccctaaccccgttacggaacccctacgtaccccgaaccggacgggggtaccgaaacggggcccgggggtaatacgggaacgggtacccgtaaacgttagttaacgttcggtacgtaagggttcgggggttaggttaacgtttaccgtaaggttacgtttacgttaccgttaagggggttccccggggggttttcgggaccggggttaacgggacccgtaaagggtccgttacggttacccggttccggttaacgggtccaaccggcccgttaacgggttccctcccggtcccccgtcgggttacccgtccttccgttccgttcccccgttccccc

SEQ ID NO: 359743 - DNA, 687 bp, Homo sapiens
  misc_feature: GZ8MTXP01CQ97F.10.80.H03.1.454.CMB.2.raw
  modified_base (369)..(369): a, c, t, g, unknown or other
  misc_feature (369)..(369): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtcgacccggccctcgaggactccctgacgccgattctgtggcctacccgaactcgtgggaaacccncgggccaccctgaccatccacgaggggtcgaaaggccggggatcgggacggcccgaattattagttggtacgtaaggggtttcggttagggttaactttttcgaaggtttaacgttactttccggtaacgggttttccccggggggggtttttacgaccgggggtaagggggtaaccctaaagggtcccgttacggaacccggttcccgttaagggttacccgacggttaccccggaaacgggttccctttcccgggcccccccctttcgggggttccctaccccgtttccgttcccgttttcccccccggtcccccc

SEQ ID NO: 359744 - DNA, 604 bp, Homo sapiens
  misc_feature: GZ8MTXP01BPJOG.10.80.H03.1.454.CMB.2.raw
  modified_base (226)..(226): a, c, t, g, unknown or other
  misc_feature (226)..(226): n is a, c, g, or t
  modified_base (376)..(376): a, c, t, g, unknown or other
  misc_feature (376)..(376): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataaccgtggtggggganacagcattgaaagtgaagctgtccactggtaccagcagaggccaggccaggccccctgtactggtcctctatgatgatacgtgacccggccctcgaggactcccgtggacgccgattctcgtcggcctaccgaactcgtacgggaaaccnccggcccaccctcgaccactccgacgagggtcgaaggccgggatggacggccgtattagttagttgtacgtagggttggtggttatttcgagttagttagttcgtacggttccgggggttttcgcgggtacgggaccaaggtcgtcggttacccgtccgttagggtcctacggcccgttacggcctaaccggcccctcggtctaccgttccgtccgttccccgtcccc

SEQ ID NO: 359745 - DNA, 682 bp, Homo sapiens
  misc_feature: GZ8MTXP01CSLPM.10.80.H03.1.454.CMB.2.raw
  modified_base (224)..(224): a, c, t, g, unknown or other
  misc_feature (224)..(224): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggcaggataacgtggtgggganacagcagtagaaagtgaagctgtccacgtggtaaccagcaggacggccgaggccacggcccctgtactggtcctctagtgatgataggtcgacccgccctcgaggtactcccgtgacgccgtactttctcgtcggcctaaccctaactcgtaacgggaaaccacccgggacccacccgtcgaaccacgtacccaacgacgggtacgaacgggccgggaatgggaacgccgtaacttagttacgtgtacgtagggttggttaggttatttcgaaggttagttacgttcggtagggtttcccggggggtttcgaccggggtaaggtaaccccgtaagggtcccgtacgggttaacccgtttccgacgggttaccgaccggttaccccgaaggggttccccttaacccggcccccgttggtaccctaccgttcccgttaacccgttccccgtaaccccccg

SEQ ID NO: 359746 - DNA, 664 bp, Homo sapiens
  misc_feature: GZ8MTXP01A9XKV.10.80.H03.1.454.CMB.2.raw
  modified_base (228)..(228): a, c, t, g, unknown or other
  misc_feature (228)..(228): n is a, c, g, or t
  modified_base (355)..(355): a, c, t, g, unknown or other
  misc_feature (355)..(355): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcaggtcggccccaggagagacggccaggataaccgtggtggggganacagcagttagaaagtgaagctgtccacgtggtaccagcaggacggccaggccaggcccctgtactggtcctctatgactgataggtcgacccgggccctgagggtactccgtgacgtccgacttcncgtcggctaacccaaacgttcgacggggaaacccacccgggacccctaaccccgtcggaaacccctacgtacccgaaccgtaacggggtaccggaacgggacccgggggagtacgggacggtaccgtaacgttaagttacgttaggtacgtaagggttgggttagggtttatttacgtagttagttacttcgtaggtttaccgggggtttcggacgggtacggtacgagcgtcgaccgtcgttaggaccgtacgacccgacgcccgtccggccccgtcggtccaccgttctccgttccccgtaaccccg

SEQ ID NO: 359747 - DNA, 706 bp, Homo sapiens
  misc_feature: GZ8MTXP01CRV98.10.80.H03.1.454.CMB.2.raw
  modified_base (226)..(226): a, c, t, g, unknown or other
  misc_feature (226)..(226): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataaccgtggtggggganacagcattgaaagtgaagctgccactggtaccagcagaggccaggccacggcccctgtactggtcctctatgatgatacgtcgacccggcctgacgggactcccgtgacgtccgtattcgtcgtcggcctaacccgaaacgtcgtacgggaaacccaccgggtcccaaccccgtcgaaccaacgtacccgaccgaacggggtaccggaaacgggtacccggggaagtacgggacgggtaccgtaaccgttaagtttacgttacggttacgtaagggtttggggttaggtttaacgttttacgtaaggttagtttaacgttcgttaacgggtttcccggggggttttacggacggggtaacgggtaccgtaaacggtcgtacgggttaccgttccgttacgggttaccgacggacccgttaacgggttcctcccggtccccgttcgggtacctccgttccgttcccgtttccccgttcccc

SEQ ID NO: 359748 - DNA, 670 bp, Homo sapiens
  misc_feature: GZ8MTXP01DP4L9.10.80.H03.1.454.CMB.2.raw
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
  modified_base (296)..(296): a, c, t, g, unknown or other
  misc_feature (296)..(296): n is a, c, g, or t
  modified_base (334)..(334): a, c, t, g, unknown or other
  misc_feature (334)..(334): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgcccacccgtcggtgtcaggtcggcccgaggagagacggcaggactaacgtggtgggganacagnattagaaagtgaagctagccatcggacagcagacgcaggccacggcccctgtactggtcctntatgatgatcggtcgacccggtcctgaggtactcccgnggacgtccgtattctcgtcggtccctaacccaaacgttccggacggggaaaccctacccgggaccccaacccgtcggaacccactacccgaacggtacggggtacggaacgggccggggtatacgggacggtaccgtagttattagttgtacgtaggttgggttaggtttagtttacgtagttagttacgttcggttacggggtttacccgggggtttcgggacggggtaacgggtaccgacggtccgtacggttacccgttcggttacggtaccgacgacccggttcggaccgtcccgtccccgtcggtcctccgttcctccggttcccctcccg

SEQ ID NO: 359749 - DNA, 710 bp, Homo sapiens
  misc_feature: GZ8MTXP01DIMJH.10.80.H03.1.454.CMB.2.raw
  modified_base (225)..(225): a, c, t, g, unknown or other
  misc_feature (225)..(225): n is a, c, g, or t
  modified_base (296)..(296): a, c, t, g, unknown or other
  misc_feature (296)..(296): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccacctcggtgtcagtcggccccaggagagacggccaggataaccgtgtggggganacagcattgaaagtgaagctgtccactggtaccagcagaggccaggccaggcccctgtactggtcctctangatgataggtcgacccggccctgagggactcccgtgacgtcccgtattctcgtcggccttacccaaacttccgtacgggaaaccacccgggcccctaaccccgtggaacccaacgtacccgaaccgaacggggtaccggaaacgggacccgggggtaagtacgggaacgggacccgtaaacttaagttacgtttaggtaccgtaagggttggggttagggtttaattttaccgaaggttaagttaacgtttccgtaacgggtttcccggggggttttacggacggggtaacgggacccgtaaaggtccgtacggacccggttaccgttacggtaccgaacggaccccgttaacggcccgttccggccccccgttcgggtcctaccttcccgttaaccgttcccccgtaaccccc

SEQ ID NO: 359750 - DNA, 720 bp, Homo sapiens
  misc_feature: GZ8MTXP01A1E1J.10.80.H03.1.454.CMB.2.raw
  modified_base (331)..(331): a, c, t, g, unknown or other
  misc_feature (331)..(331): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgccgacctcctatgtgctgtctcacgcccacccgtcggtgtcgaggtcggccccgaggagacggaccggccaaggtactaaccgtgggtagggggagacagactagttaggaaagtgaacgtctcgtaccgacgtcggaaccagcgaggacggccgacggccgacggccccgtgtactcggtcctntagtgatgaagtacggtccggacccggcctacggaggtacctccgtaggacgtccggtacttcgtcgcggtacctaaccctaacgtcggtacgggaaaccgtcccgacccctaccgtacgaacctctacccgacgggtagggacccggaacgggcccggggtaagtaccgggaaggtacccgttaagttacgtttagtcggtagttagggttaggttaggtttagtttacggaagttaggttaccgtttcggttaccggggtttccgggggttagaccggggacggtacctgggtaaccttccgggacgtaccggttgaccgtccggcccgttacggcccttcccggccccgtgtacctcccgttcccttccccgttccccctaacccc

SEQ ID NO: 359751 - DNA, 758 bp, Homo sapiens
  misc_feature: GZ8MTXP01B15RL.10.80.H03.1.454.CMB.2.raw
  modified_base (224)..(224): a, c, t, g, unknown or other
  misc_feature (224)..(224): n is a, c, g, or t
tcagcatagtagtgcacgaccggtgctcgatttagctgtgcgtcgaagggaaagggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataaccgtgtggggganacagcattgaaagtgaagctgtccactggtaccagcagaggccaggccaggcccctgtactggtcctctatgatgatagtcgacccggtccctacgagggactcccgtgacgtccgtacttctcgtcggcctacccgtaaactccgtaacggggaaaccctacccgggacccctaaccccgttaccgaaacgtacccgtaacccgaacggggtaaccggggaaacgggccgggggtaacgttacgggaacggggtacccgtaacgttaaacggtttattacggttacgtaggggttagggtttacgggggtttaatttttaaccggtaaggtttaacggtttaacgtttccggttaacgggtttcccgggggttttttacgggggacggtaaccgggggtaacctaacggtacgtaacggtacccggttacgtaacgggttaccgtaccggtacccgaacgggttccgttacccgtcccccgttccgggtcctcccttccgttcccggtttcccccgttccccgttaacccccg

SEQ ID NO: 359752 - DNA, 635 bp, Homo sapiens
  misc_feature: GZ8MTXP01D72KM.10.80.H03.1.454.CMB.2.raw
  modified_base (228)..(228): a, c, t, g, unknown or other
  misc_feature (228)..(228): n is a, c, g, or t
  modified_base (294)..(294): a, c, t, g, unknown or other
  misc_feature (294)..(294): n is a, c, g, or t
  modified_base (390)..(390): a, c, t, g, unknown or other
  misc_feature (390)..(390): n is a, c, g, or t
tcagcatagtagtgcacgaccggtgctcgatttagctgtgcgtcgaagggaaggggctgggcctaaggaagcagcactggtggtgcctcagccatggcctggaccgttctcctcctcggcctcctctctcactgcacagcctctgcgacctcctatgtgctgtctcacgccacccgtcggtgtcaggtcggcccgaggagacgacggccaggataacgtggagggganacagcagttagaagtgaagctgcagtgaccagcagacgcaggccacggtcccctgtactggtcctntatgatgatggtcgaccccggtcctagaggacctccgtggacgtcccgtacttcgtacgtcggtccctaaacccgaacgttcgaacggggaaaccncccgggacccctaccgtacgacctactaccgaccggtagggacggacggccgggagtacggacggtacctagttagttagttgtagtagggttgggttgttaacgttgtaaggttaagttcgttcggtaacgggtttcccgggggtttggacggggtacggaccgaagtcgtacggttacccgtcgttcggacgcgacccgaggccctcggccccgtggctaccttcgtcccgttcccctaaccc

SEQ ID NO: 359753 - DNA, 737 bp, Homo sapiens
  misc_feature: GZ8MTXP01BWJXC.10.80.H03.1.454.CMB.2.raw
  modified_base (240)..(240): a, c, t, g, unknown or other
  misc_feature (240)..(240): n is a, c, g, or t
  modified_base (340)..(340): a, c, t, g, unknown or other
  misc_feature (340)..(340): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgccctacccgtcggtgtcaggtcggaccccgaggagacggacggaccaaggactaaccgtgggtggggganacgagctagttaggaaaagttgaaagtcgttacgtccgtacgtcggtaaccagacgaggacggaccacggccacggtcccctagtaccgttggtcccctntaagtgacgtagtacgtagggaccgaccccggtcctacggacgggtacctcccgtggaacgtccgtctttcctaccgtcggtccctaaaccgtaaccgttcggtacgggaaaccctcccgggacccctaccgtacggaaccacgtacccgaaccggtacgggtaaccggaacgggtcccgggggtaatacgggacggtaaccgtacgtttaacgttacgtacggttacgtaagggtttagggttacggtttagtttacgtaaggtttacggttaacgtcggttacggggtttccgggggtttacggacgggtaacggaccgtacgcgtacgttaccgtcgttaggcacgccgacggttcctccgtccctcggtccacgttccgtccgttcccgtccc

SEQ ID NO: 359754 - DNA, 644 bp, Homo sapiens
  misc_feature: GZ8MTXP01ARUEN.10.80.H03.1.454.CMB.2.raw
  modified_base (231)..(231): a, c, t, g, unknown or other
  misc_feature (231)..(231): n is a, c, g, or t
  modified_base (309)..(309): a, c, t, g, unknown or other
  misc_feature (309)..(309): n is a, c, g, or t
  modified_base (617)..(617): a, c, t, g, unknown or other
  misc_feature (617)..(617): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgccgacctcctatgtgctgtctcacgcccacccgtcggtgtcaggtcggccccaggagagacggcaggataaccgtggtggggganacagcattagaaagtgaagctgccacgtcggtacagcgaggacggccaggcccacggtccccctgtaccgtggtcctntatgatgatgtcgcccgccctgaggactccgtgacgcctattcgtctcgcctaaccacgtcgacgggaaaccaccggccccaccgtagaccctactaccgaccgaggggtaccgaacgggccgggagtcggacgaccgtagttacgttagttgtacgtagggttcgggttgtaagtttcgtaaggttagttacgttcggttacgggttcccgggggtttagacggggtacggtacgaaggtcgtacggttaccgtccgttacggtaccgacgacccggttcgcccgtcccgtccccgtaacggtcccnccgtttccgtccccgttccccgtcccc

SEQ ID NO: 359755 - DNA, 724 bp, Homo sapiens
  misc_feature: GZ8MTXP01AYOP8.10.80.H03.1.454.CMB.2.raw
  modified_base (182)..(182): a, c, t, g, unknown or other
  misc_feature (182)..(182): n is a, c, g, or t
  modified_base (227)..(227): a, c, t, g, unknown or other
  misc_feature (227)..(227): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagcccaccctcggtntcagtggccccaggagagacggccaggataaccgtggtggggganacagcattgaaagtgaagctgtccactggtaccagcagaggccaggccaggccccctgtactggtcctctatgatgatagtcgaccgccctcgagggactccccgtggagcccgtacttcgtcgtacggcccttaacccaaacttcgtacggggaaacccacgggccccaaccccgtgaacccactccgaccgaggggtccgaaacgggcccgggggatcgggaacgggccccgtaagttaagttacgttgtcgtagggttggggttgggtttaatttcgaaggtttagtacgtttaccggaacgggttttcccggggggtttttacgggcggggtaacggggtaaccccgaaaggtcccgttacggttaaccccggtcccgttaaacgggtcccgaaaccggcccccgaaacggggttccccttcccggggcccccccctttaacggggtccctaacccggtttccccttcccggttttcccccctaacccccccg

SEQ ID NO: 359756 - DNA, 726 bp, Homo sapiens
  misc_feature: GZ8MTXP01BHK1B.10.80.H03.1.454.CMB.2.raw
  modified_base (227)..(227): a, c, t, g, unknown or other
  misc_feature (227)..(227): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagcccaccctcggtgtcagtcggccccaggagagacggccaggataaccgtggtgggganacagcagtagaaagtgaagctgtccagtggtaccagcagacggccaggccacggcccctgtaccgtggtcctctatgatgatggtcgacccgcctcgaggtactcccgtgacgtccgtacttcgtcgtcggccttaacccaaacgttcggtacgggaaacccgacccgggacccctacccgtacggaccctaacgtcccgaaccggtaacggggaccggaaacggggacccggggtaagtaccggggaacgggtaccccgtaacgttaagtttacgttcggtacgttaggggttcggggtttaggtttaacgttttccgaagggttttagtaacgtttcggttaacgggttttccccggggggtttacggacggggtaacggacccgtaaggtccgttacgggacccgttcgttaacgggccaacggaccccgttaacggttccctaacccggtccccccgtggtccctaccttcccgttcccgttcccccgtaacccc

SEQ ID NO: 359757 - DNA, 637 bp, Homo sapiens
  misc_feature: GZ8MTXP01AG589.10.80.H03.1.454.CMB.2.raw
  modified_base (612)..(612): a, c, t, g, unknown or other
  misc_feature (612)..(612): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagttcgccccaggagaggacggccaggactaaccgtggtggggagacagcattagaaagtgaagctgtccacgtcggtacagcagaggccacggccacggcccctgtactggtcctctatgatgatacgtcgaccggcctcgaggctccgtgacgccgtattcgtcgtcggcctaaccgaacgtcgtacgggaacccaccgggcccacccgtgaccactacgaaccgacggggtaccgaacgggcccggggatcggacggaccgtaacttagttagttgtcgtaggttgggttagttagtttacgtaaggttagtgtttcgacgggtttccggggggtttcggacgggtacgggtaaccaacggtccgtcggttacccggttcgttaggtccgacggcccgacggccgtcccggccccgttcggtaccnccgttccctccggttcccctccccg

SEQ ID NO: 359758 - DNA, 721 bp, Homo sapiens
  misc_feature: GZ8MTXP01BG860.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgccgacctcctatgtgctgtctcacgcccacccgtcggtgtcagtcggccccaggagagacggccaggactaaccgtggtggggagacagcattagaaagtgaagctgtccacgtggtaccagcgaggacggccgacggccacggtcccctgtactggtcctctatgatgagtacggtcgacccggcctacggaggacctccgtaggacgtccgtacgttcgtcgtcggtacctaacccgtaacgtcggtacgggaaacccgacccggacccctacccgtacgaccctacgtacccgaaccggtacggggtacggaacgggaccggggagtacgggaaccgggtaccgtaactttaagttacgttacggtacggtacgggttggggttaggtttacgtttacgtaaggttagttacgttcggttacggggtttccggggggtttcggacggggtaacggtaccgaggtccgtacggttaccccgtacgttacgggtaccaccggaccccgacggttccccgtaaccccgtccccgttccgtaccgtcccgttccgttccccgttcccccgtccccc

SEQ ID NO: 359759 - DNA, 595 bp, Homo sapiens
  misc_feature: GZ8MTXP01B8XHN.10.80.H03.1.454.CMB.2.raw
  modified_base (223)..(223): a, c, t, g, unknown or other
  misc_feature (223)..(223): n is a, c, g, or t
  modified_base (330)..(330): a, c, t, g, unknown or other
  misc_feature (330)..(330): n is a, c, g, or t
  modified_base (513)..(513): a, c, t, g, unknown or other
  misc_feature (513)..(513): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggcaggataactggtgggganacagcattagaaagtgaagctgtccactggtaccagcagaggccaggccacggcccctgtactggtcctctatgatgatagtcgacccggccctgagggactcccgngagccgtattctcgtcggctaacccaactcgtacgggaaaccaccggcccacccgtcgaaccactaccgacgagggtacgaacggccggggaatcggacggtaccgtaacttaattacgttgtacgtaggttggggttaggttaatttcgaagttagttattcgaggtttccgggggtttcgngggtacggacaagtcgtgaccgtcgagtcgacgccgaacgcgtcccgtccccgtggtccacgttccttccgttcccgtcccc

SEQ ID NO: 359760 - DNA, 655 bp, Homo sapiens
  misc_feature: GZ8MTXP01BNEUG.10.80.H03.1.454.CMB.2.raw
  modified_base (227)..(227): a, c, t, g, unknown or other
  misc_feature (227)..(227): n is a, c, g, or t
  modified_base (301)..(301): a, c, t, g, unknown or other
  misc_feature (301)..(301): n is a, c, g, or t
  modified_base (624)..(624): a, c, t, g, unknown or other
  misc_feature (624)..(624): n is a, c, g, or t
tcagcatagtagtgcacgaccggtgctcgatttagctgtgcgtcgaagggaaagggctgggcctaaggaagcagcactggtggtgcctcagccatggcctggaccgttctcctcctcggcctcctctctcactgcacagcctctgcgacctctatgtgctgtctcacgccaccctggtgtcagtcggccccaggagagacggccaaggactaaccgtggtagggganacagcattagaaagtgaagtctgccactggtaccagcaggacgcgacgcgacgccctagtcgtcgtcctctagngagtagtagtacggtaccggccccgtccgtacggtacggtcccgttacgcggtaccgtacggttacttccgtcggtccgtaccctaaacccgtaacgttcggaaccgggaacccgacccggacccctaccgtacgacgtactaccggacggttacggacggacgggacggtagacggacgtaccttataagttgactaggtagttggggttattattacggagttacgttcgaccggtttcggggttacccgggggttggaccggttaaggaccaggtcgtacggttccgtacgttggaccgaccgttcggacttccgtcccncgttccgactcgcctcccgttccctaacccg

SEQ ID NO: 359761 - DNA, 671 bp, Homo sapiens
  misc_feature: GZ8MTXP01B3ZFN.10.80.H03.1.454.CMB.2.raw
  modified_base (224)..(224): a, c, t, g, unknown or other
  misc_feature (224)..(224): n is a, c, g, or t
  modified_base (234)..(234): a, c, t, g, unknown or other
  misc_feature (234)..(234): n is a, c, g, or t
  modified_base (301)..(301): a, c, t, g, unknown or other
  misc_feature (301)..(301): n is a, c, g, or t
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
  modified_base (375)..(375): a, c, t, g, unknown or other
  misc_feature (375)..(375): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgccgacctcctatgtgctgtctcacgcccacccgtcggtgtcaggtcggccccgaggagacgacggccaggactaacgnggtggggganacgagcagttagaaagtgaagctcgccacgtgacagcagacgcaggccacggccctgtactgtcctntatgatgatcgcgacccgcctgacggctccgngacgcctattcgngtccgctaaccaacgttcgacgggaaccncggacccacctacgacacgtacgacgaggtacggacgaccgggataggacgaccgtaattagttaagtggtacgtagggttgggttacgttaacgtttcgaaggtttaacgttacggttcggtaaccgggggttttcccggggggttttacgggaaccgggtaggggtaacccgaacggtccgggttaacggttaccccggtacggttaccggaacgcccggttaccccggttaaggcccgtccccggtcccccgtggttacccctcccgttcgttcccccgttccccctaacccc

SEQ ID NO: 359762 - DNA, 718 bp, Homo sapiens
  misc_feature: GZ8MTXP01A3IJR.10.80.H03.1.454.CMB.2.raw
  modified_base (230)..(230): a, c, t, g, unknown or other
  misc_feature (230)..(230): n is a, c, g, or t
  modified_base (396)..(396): a, c, t, g, unknown or other
  misc_feature (396)..(396): n is a, c, g, or t
tcagcatagtagtgcacgaccggtgctcgatttagctgtgcgtcgaagggaaaggggctgggccgtaaggaagcagcactggtggtgcctcagccatggcctggaccgttctcctcctcggcctcctctctcactgcacagcctctgcgacctcctatgtgctgtctcagcccaccctggtgtcagtcggccccaggagacgacggccagggactaaccgtggtgggganactagcagttagaaagtgaagctgccactggtaccagcagacggcacggccacggcccctgtactggtcctctatgatgatcgtcggacccggcctcggaggtctcccgtggacgcccgtattcgtacgtcggccttaaacccaacgttccgacggggaaaccccnccggtaccccaccgtacgaacccacgtacccgaccggtaacggggtaccggaaccgggtaccggggagtacgggaaccggtaccgttaacgttacgttacgttacggtacggttaggttcggggttacgtttaagtttacgtaagttacgttacgttcgggttaccggggtttccgggggtttacggacggggtaacggtaccgaacggtccgtacggttacccggtaccgttacgggtaccgtaccgttacccggttacggttcccgtccccggtccccgttcgtaccctaccgttcccgttcccgttaacccccgtcccg

SEQ ID NO: 359763 - DNA, 713 bp, Homo sapiens
  misc_feature: GZ8MTXP02FX5S7.10.80.H03.1.454.CMB.2.raw
  modified_base (225)..(225): a, c, t, g, unknown or other
  misc_feature (225)..(225): n is a, c, g, or t
  modified_base (294)..(294): a, c, t, g, unknown or other
  misc_feature (294)..(294): n is a, c, g, or t
  modified_base (340)..(340): a, c, t, g, unknown or other
  misc_feature (340)..(340): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagcccaccctcggtgtcagtcggcccaggagagacggccaggataacctggtgggganacagcattagaaagtgaagctgccactggtaccagcagaggccaggccacggcccctgtactggtcctntatgatgatgtgacccgcctcgaggactccctggacgccgattccnctggcctaccaaactcggtacggggaaacccaccggggacccccaacccccgttacggaaacccacttacccgaacccgtaacgggggtaccggaaaacggggaccccgggggtaatacggggaaccggggtacccggtaaacttaagtttaaacgtttgggtaccggtaaggggttggtttaggggtttaattttaccgtaaagggttaagttaacgtttccggtaacggtttcccggggggtttttacgggacggggtaacggggtacccgaaaggtccgtacggtaaccggttccgtaacgggtcaacggacccgaaggtccgtccgcccccgttcggtacctaccttccgtccgttcccctaacccccg

SEQ ID NO: 359764 - DNA, 573 bp, Homo sapiens
  misc_feature: GZ8MTXP02G3H61.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgtgacctcctatgtgctgtctcagccaccctcggtgtcagtggccccaggagagacggccaggataacctggtgggggagacagcattgaaagtgaagctgtccactggtaccagcagaggccaggccaggcccctgtacctggtcctctatgatgatagtgacccggccctcgagggactcccgtgacgccgtattcctctcggctaccaactcgtacgggaacaccggcccaccctcgaccatccaccgagggtcgaaggccggggatgacggccactattagtgtacaggttgtggttatttcgagttagtattcgtaggttccgggggtttcggcgggtagggaccaaggtcgtcgaaccgtctacggtccacgcccgaaggcctccggcccccgtcggtcacctccgtccgttccccgtcccc

SEQ ID NO: 359765 - DNA, 526 bp, Homo sapiens
  misc_feature: GZ8MTXP02GOLKV.10.80.H03.1.454.CMB.2.raw
  modified_base (315)..(315): a, c, t, g, unknown or other
  misc_feature (315)..(315): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgacccggcctnagggatccctgagccgattctctggctccaactctgggaacacggccaccctgaccatcaccgagggtcgaaagccggggatgacggccgactatatgtcaggtgtggtatttcgagttagtattcgagttccgggggtttcgcggtagggaccaaggctgaccgtctaggtcagcccaaggctcgcccctggtcactctcgttcccaccc

SEQ ID NO: 359766 - DNA, 534 bp, Homo sapiens
  misc_feature: GZ8MTXP02IW3BS.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgacccggcctcgagggactccctgagccgattctctggctccaactcgtagggaaacaccggccaccctgaccatccaccgagggtcgaaggccggggatgacggccgactatatgtcgaggttgtggttattcgagtagtattcgtagttccgggggtttgcggtaggaccaagcgtgaccgtcgtaggtcacgccaaggctcgcccctggtcactctcgttcccgccc

SEQ ID NO: 359767 - DNA, 561 bp, Homo sapiens
  misc_feature: GZ8MTXP02GWNGO.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataaccgtgtgggggagacagcattgaaagtgaagctgtccactggtaccagcagaggccaggccaggcccctgtactggtcctctatgatgatagtgacccggcctcgagggactcccgtgagccgattctctggctccaactcgtagggaaacaccggccaccctgaccactccaccgagggtcgaaacggccggggatggacggccgactattatgtcaggtgtaggttattcaggttatagttcgaggttccgggggtttggcgggtacgggaccaaggtctacggaccgtctagggtcacgacccaaggcctccggccccctcggtccactcctcgttccccgtcccc

SEQ ID NO: 359768 - DNA, 558 bp, Homo sapiens
  misc_feature: GZ8MTXP02IBSLP.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtgggggagacagcattgaaagtgaagctgtccactggtaccagcagaggccaggccaggcccctgtactggtcctctatgatgatagtgaccggcctgagggatcccgtgacgccgattctctcggctccaactcgtagggaacaccggcccaccctgaccatccacgagggtcgaaggccggggatggacggccgaactattacgtgtcgtaggttgtaggttatttcgagttagtattcgtagttccgggggtttcggcggagggtaccaaggtcgtagaccgtcgtacgggtcacgcctaaggcctcgcccctcggtcacgtcctacgttccccaccc

SEQ ID NO: 359769 - DNA, 530 bp, Homo sapiens
  misc_feature: GZ8MTXP02J2ALT.10.80.H03.1.454.CMB.2.raw
  modified_base (417)..(417): a, c, t, g, unknown or other
  misc_feature (417)..(417): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtgggggagacagcattgaaagtgaagctgtccactggtaccagcagaggccaggccaggccccctgtactggtcctctatgatgatagtgaccggcctcagggatccctgagccgattctctggctccaactctgggaaacacggccacctgaccatcaccagggtcgaagccggggatgagccgactattatgcaggtntggtatttcagttagtattcgagttccgggggttttcgcgggtagggaccaagcgtgaccgtccgtaggtcagccccaaggctcgccccctcggtcactctcgttcccacccc

SEQ ID NO: 359770 - DNA, 726 bp, Homo sapiens
  misc_feature: GZ8MTXP02F1KKN.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataacctggtgggggagacagcattgaaagtgaagctgtccactggtaccagcagaggccaggccaggcccctgtactggtcctctatgatgataggtgacccggccctcgagggactcccgtggacgcccgtattcctcgtcggcctaccaaacttcgtacgggaaaccaccgggaccccaccccgtagaacccactacccgaacccgtacggggtaccgaaacgggcccggggaagtacggacgggaccgtaacgttaagttaagttcgtacgtaaggttggttagggtttatttacgtaaggttacgttaagtttcgtaacgggtttcccggggggtttttacgggaccggggtaaacggggtaacccgtaaaggtaccgttacgggtaacccggttaccggttaaacgggttccgtaaccggtaccccggaaacgggtcccgtaaccccgggtccccccgttccgggttaccctaacccgtttccgttacccggtttcccccgttaccccccg

SEQ ID NO: 359771 - DNA, 515 bp, Homo sapiens
  misc_feature: GZ8MTXP02JEUT6.10.80.H03.1.454.CMB.2.raw
  modified_base (313)..(313): a, c, t, g, unknown or other
  misc_feature (313)..(313): n is a, c, g, or t
tcagcatagtagtgcacgaccggtgctcgatttagctgtgcgtcgaagggaaagggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagagccaggccaggcccctgtactggtcctctatgatgatagtgaccggccctnagggatccctgagccgattctctggctccaatctgggaacacggccacctgaccatcacaggtcgaagccggggatgagccgactatatgtcaggtgtggtatttcagttagtattcatccgggggttttgcggagggaccaaggctggaccgtcctaggtcagcccaaggctgccccctggtccactctcgtttcccgccc

SEQ ID NO: 359772 - DNA, 557 bp, Homo sapiens
  misc_feature: GZ8MTXP02F6344.10.80.H03.1.454.CMB.2.raw
  modified_base (398)..(398): a, c, t, g, unknown or other
  misc_feature (398)..(398): n is a, c, g, or t
  modified_base (554)..(554): a, c, t, g, unknown or other
  misc_feature (554)..(554): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggccccctgtactggtcctctatgatgatagtgacccggccctcaggggactccctgagccgattctctggctccaactctgggaacacgggcccaccctgaccatcaccagggcaagccgggangaggccgactattatgtcaggtgtggttatttcagttagtattcagttccgggggttttcggcgggaggggtaccaaaggcgtcggaaccgtccgtaagggtcacggaccccaagggccctccgtcccccgtcggtccaccgtctccgttaccccnccc

SEQ ID NO: 359773 - DNA, 610 bp, Homo sapiens
  misc_feature: GZ8MTXP02GZOUM.10.80.H03.1.454.CMB.2.raw
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
  modified_base (340)..(340): a, c, t, g, unknown or other
  misc_feature (340)..(340): n is a, c, g, or t
  modified_base (367)..(367): a, c, t, g, unknown or other
  misc_feature (367)..(367): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtgggggagacagcattgaaagtgaagctgtccactggtaccagcagaggccaggccacggccccctgtactggtcctntangatgatagtgacccgcctgagggactccctgagccgtattcnctggcctccaactcgtacgggaaaccnccggcccaccccgtgacccatccgaccgaggggtcgaaacgggcccgggggatcggacgggcccgtaattacgttagttcggtacgagggttggtggtttaatttcgaggttagttacttcgtaggtttccggggggtttcgcgggtaagggacccaaggctaggacccggtcgtaagggtcaccggacccgaaggtccgtcgccccccgtaggtcccacgttccttccggtcccccgtcccc

SEQ ID NO: 359774 - DNA, 563 bp, Homo sapiens
  misc_feature: GZ8MTXP02G3BKB.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtcgacccggcctcagggactccctgagccgattctctggcctaccaactcgtggggaaaccaccggcccaccctgacccactccaacccgaggggtacgaaaggcccggggaatggaacgggcccgaacttattagttgtacagggttgtggttaattcaggttagtattcgagttccgggggtttgcggaggggaccaagctagaccgtcgtaggtcacgacccgaaggctcggcccctcggtcactctcgtccgcccc

SEQ ID NO: 359775 - DNA, 570 bp, Homo sapiens
  misc_feature: GZ8MTXP02GM5U5.10.80.H03.1.454.CMB.2.raw
  modified_base (367)..(367): a, c, t, g, unknown or other
  misc_feature (367)..(367): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggcccaggagagacggcaggataacctgtgggggagacagcattgaaagtgaagctgtccactggaccagcagaggccaggccaggcccctgtactggtcctctatgatgatagtgacccggccctgagggactccctgagcccgtattcctctggcctacccaacttcgtagggaaaccncgggccccaccctgacccataccaccgagggtacgaaaggcccggggagtgacggccgacgtattattgtacagggtgttaggttattcgagttagtaattcgaacgttccgggggttttcggcggtagggaccgaagcgtcggaccgtcctaggtacacgacccaacggctcgcccccgtcggtccactctcgtccgtcccc

SEQ ID NO: 359776 - DNA, 802 bp, Homo sapiens
  misc_feature: GZ8MTXP02IWJ3E.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggcccaggagagacggccaggataacctggtgggggagacagcattgaaagtgaagctgtccatggtaccagcagagccaggccaggcccctgtactggtcctctatgatgataggtcgacccggccctgacgggactcccgtaggacgccgtattccgtcgtcggcctaccgaaacttcggtacggggaaaccaccgggccccaacccgttcgaaccctactacccgaacccgaagggggttacccgaaacgggggtcccgggggaagttcggggaaccggggtacccgtaaacgtttaacgtttaaagttcggtttaccggtaagggggttttacggttagggggttttaactttttaccggaaagggtttaacggtttaaacgtttccgggttaaacgggtttcccggggggggtttttacgggaccgggggttaaacgggggaacccgttaaaacgggtccgtacgggtaaaccccggggttaccgttaaacggggttacccgaaccgggtaacccccgaaaagggggtccccgttaacccgggtacccccccggttacggggtaccctacccggtttacccggttcccggttttacccccccggtcccccg

SEQ ID NO: 359777 - DNA, 558 bp, Homo sapiens
  misc_feature: GZ8MTXP02FMFQ9.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggccccctgtactggtcctctatgatgataggtgacccgggccctcgaggggactccccgtgacgcccgattcctctggcctcccaaactctggggaaacaccggcccaccctgacccatccaccagggtcgaaggccggggatggaggccgactattattgtcaggtgtggtatttcgagtagtattcgagttccgggggtttgcgggtagggaccaaggtctaggaccgtccgtaggtccacgacccaaggctcgcccctcggtcacgtctcgttcccacccc

SEQ ID NO: 359778 - DNA, 532 bp, Homo sapiens
  misc_feature: GZ8MTXP02F3PEG.10.80.H03.1.454.CMB.2.raw
  modified_base (293)..(293): a, c, t, g, unknown or other
  misc_feature (293)..(293): n is a, c, g, or t
  modified_base (317)..(317): a, c, t, g, unknown or other
  misc_feature (317)..(317): n is a, c, g, or t
  modified_base (468)..(468): a, c, t, g, unknown or other
  misc_feature (468)..(468): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacgaccaggataacctgtgggggagacagcattgaaagtgaagctgtccactggtaccagcagaggccaggccaggccccctgtactggtcctntatgatgatagtgacccggccctnagggactcccgtgagcccgattcctctggcctccaactctggggaaacaccggcccaccctgaccatccaccgagggtcgaagcccggggatggacgccgactattatgcaggtgtggttattcagtagtattgagttccgggggtttcgnggagggaccaaggctgaccgtctaggtcacgcccagctcgcccctggccatcgtcgtcccaccc

SEQ ID NO: 359779 - DNA, 669 bp, Homo sapiens
  misc_feature: GZ8MTXP02JQ3MV.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaagataacctggtgggggagacagcattgaaagtgaagctgtccactggtaccagcagaggccaggccaggcccctgtactggtcctctatgatgatagtgacccgggccctgagggactccctgacgccgattctctcggctccaactcgtaggggaaaccaccgggcccaccctcgacccaatcccaaccgaggggtaccgaaacggcccgggggaatcggacgggcccgtaacttaagttacttggtaccgaggggttggttagggttatttcgaaggtttagttagtttccggtaggtttcccggggggtttttcggacggggtaacgggggacccgtaaaggtccggtacggacccgggttcccgtaagggttccgaccggaccccgtaacgggcccgtccggtcccccccgttcggggtccctacccgttccgttacccggttccccctaaccccccg

SEQ ID NO: 359780 - DNA, 585 bp, Homo sapiens
  misc_feature: GZ8MTXP02GOIHY.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggccccctgtactggtcctctatgatgatagtgacccggcctgagggatccctgagccgattctctggctccaactcgtacggggaacaccgggcccaccctgaccactaccacccgagggtccgaaacggcccgggggaatcggacgggccgaacgttagttagttcgtacgtagggttggttgggttaatttcgaaggttagtattcgtaggttccgggggtttcgcgggtagggacaaggctacggaccgtcgtaggtcgacgacccgaaggcctcgcccccgtcggtccactctccgttaccccaccc

SEQ ID NO: 359781 - DNA, 578 bp, Homo sapiens
  misc_feature: GZ8MTXP02GDZPK.10.80.H03.1.454.CMB.2.raw
  modified_base (369)..(369): a, c, t, g, unknown or other
  misc_feature (369)..(369): n is a, c, g, or t
  modified_base (538)..(538): a, c, t, g, unknown or other
  misc_feature (538)..(538): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtcgacccggccctcgagggactcccgtgacgccgtattcctctcggcctccaactcgtgggaaccnccggccaccctgaccatcaccgagggtacgaaggcccggggatcggacggccgtacgttattacgttgtacgagggttgtgggttatttcgaggttagtattcgaggttccgggggtttgcgggtagggacaaggtcgtagaccgtcgtaggtcacgtaccaaggtccnccggccccctcggtcctaccgtccgttcgtcccccgtccc

SEQ ID NO: 359782 - DNA, 735 bp, Homo sapiens
  misc_feature: GZ8MTXP02GGMCA.10.80.H03.1.454.CMB.2.raw
  modified_base (443)..(443): a, c, t, g, unknown or other
  misc_feature (443)..(443): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagactctgtgacctcctatgcgctgactcagcccaccctcggtgtcagtcggccccaggacagacggccacgctgacctggtggggatacactaattggaagtaatcgtgtgcacgtggtaccagcgaggacggccgacggccgacggtccccgtggttggtttcgttcgtactaagtaacgtgaacgtaaccggaccccggtcccctacggacgggtacctcccgtagacgtcgtacttcccgtcgtcggtcctaccgtacgttccgggacaccgccggacccacctcactcactccgaccggngggtcggacgggaccgggatcggacggtcccgtactaaccgtcgtcggtacgtaggggttacggtacgggttaactttccgaacgtttacgtacgtaacgttccggttaggggttgggggtttaccgggggttccgttacccgggggacggggtaaccgggaaccggtaacggtcccggttaccgggtaaccccgttacggttaccgtacccggaccggaccccggtaagggttcccccgtacccggtccccccggttcggtacccctaccgttccccggtttaaccccccg

SEQ ID NO: 359783 - DNA, 724 bp, Homo sapiens
  misc_feature: GZ8MTXP02HQ2KF.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtggggagacagcattgaaagtgaagctgtcactggtaccagcagaggccaggccaggcccctgtactggtcctctatgatgataggtcgacccggcctgagggactcccgtgacgccgattctctggctcccaatcgtacggggaaccacgggcccaccctggaccactccaaccgagggggtaccgaaagggcccgggggaatcggacgggtcccgaactttagttacgttgtacgtaggggtttgttagggtttaatttcgaagggtttacgttaacgtttccgtaacggggtttccccgggggggtttttacggaccgggggttaacgggggaacccgaaaacgggtccggttacgggtaaccccggtttcccggttaaacggggttcccaaccgggacccccgtaaaagggggtcccccttaaccggggtaccccccccgttacggggtttcccccaaccgtttcccccggttacccggggtttttaccccccccgtcccccg

SEQ ID NO: 359784 - DNA, 630 bp, Homo sapiens
  misc_feature: GZ8MTXP02HQ70Y.10.80.H03.1.454.CMB.2.raw
  modified_base (330)..(330): a, c, t, g, unknown or other
  misc_feature (330)..(330): n is a, c, g, or t
  modified_base (333)..(333): a, c, t, g, unknown or other
  misc_feature (333)..(333): n is a, c, g, or t
  modified_base (361)..(361): a, c, t, g, unknown or other
  misc_feature (361)..(361): n is a, c, g, or t
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
  modified_base (467)..(467): a, c, t, g, unknown or other
  misc_feature (467)..(467): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgccacccgtcggtgcaggtcggcccgaggagacggaccggccgaaggaactaaccgtgggtagggggaagacgaggactagttaggaaagtaggaagctcgtcccagtcggtaaccagcaaggacggccgacggccgacggcccctgtacgtcggtccctntangatgatagcgacccgcctggacggctgngctctctgtcgtcactacctcgtcggaacgaccgacccaccctacgacactcccaacgacggtacggacggaccggggngngtacggcgtaacttaattgttacgngtaggttcggttgtttattacgtagtaagttcttcgttacggggttccgggggtttacggacgggacgggtaaacccgagtacgtaccggtccgtacgtacgtacgcgaccggacgtcctcccgcccgttcggtacacgtccttccggtcccctccctacccc

SEQ ID NO: 359785 - DNA, 716 bp, Homo sapiens
  misc_feature: GZ8MTXP02H3J1Q.10.80.H03.1.454.CMB.2.raw
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccacctcggtgtcagtcggcccaggagagacggcaggactaacgtggngggganacagcattagaaagtgaagctgtaccacgtggtaccagcaggacggccaggccacggcccctgtactggtcctctatgatgataggtcgacccggcctgagggactccccgtgacgcccgtattccgtcgtcgggtcctacccgtaaacttccgggtacggggaaaccaccccggggaccctaacccccgtcggaaaccctacgtacccgaacccggaacggggtaccgggaaacggggcccgggggaattaccggggaacgggacccggtaacttaagtttacgttacgttaccggtaagggtttcggttaggttttaagtttccgtaaggttagttacgtttacgtaacggggttttcccggggggtttcgggacggggaacgggtaccgtaaacggtccgtacggtacccggtcgtaacggtcgacggaccccgaaggtcctcccggcccccgtcggtcctaccgtccgttaccgttccccctacccccg

SEQ ID NO: 359786 - DNA, 554 bp, Homo sapiens
  misc_feature: GZ8MTXP02FYVWP.10.80.H03.1.454.CMB.2.raw
  modified_base (225)..(225): a, c, t, g, unknown or other
  misc_feature (225)..(225): n is a, c, g, or t
  modified_base (370)..(370): a, c, t, g, unknown or other
  misc_feature (370)..(370): n is a, c, g, or t
  modified_base (442)..(442): a, c, t, g, unknown or other
  misc_feature (442)..(442): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtggggganacagcattgaaagtgaagctgtccactggtaccagcagaggccaggccaggcccctgtactggtcctctatgatgatagtcgacccggccctgagggactccccgtgagccgattctcgtggcctaccaactcgtagggaaaccnccggcccaccctgaccatcaccgaggtcgaacgccggggatggacggcgactatactgtacgaggtgtggtnttcgagtatattcgaggttcgggggttttcggcgggagggtaccaaggcgtgaccgtcgtaggtcacgacccgagccgtcgccccgtcggtccacgtctcgttcccgtcccc

SEQ ID NO: 359787 - DNA, 564 bp, Homo sapiens
  misc_feature: GZ8MTXP02JZADJ.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtcgaccgcctcagggactccctgagccgattctctggctccaactcgtagggaacaccggccaccctgacccatccacccgagggtccgaacggcccggggatggacgggccgaactattattgtcgtaggttgtggtatttcgagttagtattcgtaggttccgggggtttcgcgggtacgggaccaaggccgtggacccgtcgtacggtcacgacccgaacggcctcgccccctggtccacgtcctcgtccccgtcccc

SEQ ID NO: 359788 - DNA, 730 bp, Homo sapiens
  misc_feature: GZ8MTXP02JSGRD.10.80.H03.1.454.CMB.2.raw
  modified_base (225)..(225): a, c, t, g, unknown or other
  misc_feature (225)..(225): n is a, c, g, or t
  modified_base (364)..(364): a, c, t, g, unknown or other
  misc_feature (364)..(364): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtggggganacagcattgaaagtgaagctgtccactggtaccagcagaggccaggccaggcccctgtactggtcctctatgatgatagtgacccggcctgagggactccctgagccgtattctctggcctccaactcgtagggaaccnccggccacccgtgacccatacccaccgaaggggtaccgaacgggcccgggggtaatacggaccggggtcccgtaaacgttaagtttaagtttcggtaccgtaaggggttggttagggtttaatttacgtaagggtttaagttaacgtttacggtaacggggttttccccgggggggtttttacggaccgggggtaacgggggtaacccgtaaacgggtcccgttacggggaacccccggttaccggttaaacggggttaccggtaacccggaccccgtaaacgggggccctttaaccgggaccccccccgtttcgggggttacccctaccgtttccccgttacccggtttccccccggttcccccc

SEQ ID NO: 359789 - DNA, 651 bp, Homo sapiens
  misc_feature: GZ8MTXP02JXY5A.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataaccgtggtgggggagacagcattgaaagtgaagctgtccacgtggtaccagcagaggccaggccaggccccctgtactggtcctctatgatgatagtcgacccggcctgaggactcccgtgacgccgtattccgtcgtcggtcctacccaacttccgtacggggaaacccacccgggaccccaacccgtcggaaccctacgtacccgaacccggagggggtaccgaaacggggtcccgggggaagtacggacgggtaccgtaacttagttagttcgtacgagggttgtaggttatttcgaaggttagtacgttcgtacgggtttccgggggtttcggacgggtacgggtaacacggtcgtacggacccgtcgttacggccacggcccgtaacggccgtccgcccccgttcggtcctaccgttcctcccgtccccgtcccc

SEQ ID NO: 359790 - DNA, 669 bp, Homo sapiens
  misc_feature: GZ8MTXP02IU521.10.80.H03.1.454.CMB.2.raw
  modified_base (225)..(225): a, c, t, g, unknown or other
  misc_feature (225)..(225): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtggggganacagcattagaaagtgaagctgtccactggtaccagcagaggccaggccaggcccctgtacctggtcctctatgatgatagtcgacccggccctcgacgggtactcccgtgacgtccgtattcctcgtcggcctaccaactcggtacgggaaaccaccggcccaacccgtcgacccactccaaccgaggggtacgaacggccggggatggacggcccgtaacttattagttgtacgtagggttggttagtttactttgaggttaagttacgtttcgtacgggtttccggggggttttacggacgggggtaacgggtaccgtaaacgggtccgtacgggtacccccggttacgtacgggtaccgaccggtacccccgaaacgggtcccgtaaccggtcccccgtacgggttcccaaccgttcccgttccgtttcccccgtccccc

SEQ ID NO: 359791 - DNA, 668 bp, Homo sapiens
  misc_feature: GZ8MTXP02IY9TG.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataaccgtggtgggggagacagcattgaaagtgaagctgtccagtggtaccagcagagccaggccaggcccctgtactggtcctctatgatgatagtcgacccggtcctgagggactccctaggacgccgtattcctacgtcggcctaccaactcgtacgggaaaccaccggcccaacccgtcgaaaccctacgtacccgaaccgacggggtaccgaaacgggcccgggggaagtacggacgggtaccgtaacgtaagtttagttcggtacgagggttgtagggtttaatttcgtagttacgttagttcgtacgggtttccgggggtttacggacgggtaacgggaccgtaaggtccgtacggtacccggtacgtacggtaccgacgacccgtaacggcccgtaaccggtcccccgtacggttacccaccgttccgttacccggttacccctacccccg

SEQ ID NO: 359792 - DNA, 703 bp, Homo sapiens
  misc_feature: GZ8MTXP02J1ZCY.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtggggagacagcattgaaagtgaagctgtccatggtaccagcagaggcccaggccacggcccctgtacgtggtcctctatgatgatagtcgacccggtccctgacgggactccccgtgacgtcccgatttcctctcggtcctacccgaacttcgtacgggaaccaccgggcccaccccgtcgacctaactccgaacccgaggggtaccgaaacgggcccgggggaatacggggacgggccgtaacgttaagtttacgttcggtacgtagggttgttggtttaacttttcgaaggtttagttacgtttaccgacgggtttcccggggggtttacgggggccgggtaacgggggaacccaaacggtccgtacggtaccccggttaccgtacgggtaccaaccggaccccgtaaggcccgttaacccggccccccgtttcgggtaccctacccgtttcccgtttcccgtttacccccccgtaacccccc

SEQ ID NO: 359793 - DNA, 786 bp, Homo sapiens
  misc_feature: GZ8MTXP02HBG0O.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgccgacctcctatgtgctgtctcacgcccacccgtcggtgtcagtcggccccaggagagaccggccaaggactaaccgtgggtagggggagacgagactagttaggaaagtgaagctgtccagtcggtaccagcaggacggccacggccacggcccctgtacgtcggtcctctatgatgatagtcgacccgcctgacggctccgtgacgccgtattcgtcgtcggcctacccaagtccgtacgggaaacctaccggacccctacccgtagacccacgtacccgaaccggtaacggggtaccggaaacgggcccgggggtaatacgggaaccgggtacccgtaaacgtttaacgtttacgttcggttaaccggtaggggtttacggtttacgggtttaagtttaccggttaagggtttaacgttaacgttttacccgggtaacgggggtttttcccggggggtttacggggaccggggtaaacggggtaacccgtaaacgggtccgtacggggtaaaccccggttcccgggttaaaggggtaccccgtacgggacccccgtaaaggggtccccgtaacccgggtcccccccgtacgggttcctaaccccgttccgtttcccccggttaccccctaccccccg

SEQ ID NO: 359794 - DNA, 664 bp, Homo sapiens
  misc_feature: GZ8MTXP02G2JCD.10.80.H03.1.454.CMB.2.raw
  modified_base (229)..(229): a, c, t, g, unknown or other
  misc_feature (229)..(229): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgcccaccctcggtgtcaggtcggccccaggagagacggccaggataacctggtggggganacagcattaggaaagtgaagctgtccagtggtaccagcagacggccaggccacggccctgtacgtcggtcctacgtatgatagagttacggtcggaccccggcccgtacgacgggtaccttccccgaggacgtcccgtactttcgtcgtcggtccctacctaacgtcggtaacgggaaaccacccgggacccacccgtacgaaccaccgtaccgaccggtacggggtacgaaacggggtcccggggagtacggacggtacccgtaagttaagttagttagtacgtaggttaggttagggttatttagtaaggttagttacgttacgtacggggtttccgggggtttacggacggggtaacggacgtaagtcgtacgaccgtcgtaggcacgaccgtagcgtccgcccctcggtccaccgtctccgtaccctaccc

SEQ ID NO: 359795 - DNA, 816 bp, Homo sapiens
  misc_feature: GZ8MTXP02IJK01.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggcccaggagagacggccaggataaccgtggtggggagacagcattgaaagtgaagctgtccagtggtaccagcagaggcaggccaggcccctgtactggtcctctatgatgatagtcgacccggccctcgacgggactccccgtgacgcccgtattccgtcgtcggccttacccaactcgtaggggaaaccacccgggccccaaccccgtgaaccctactaccgaaccgacggggttaccggaaacggcccggggggtaaagttacgggaaccggggacccgtaaacgttaaacgtttacgtttacggttacgtaacggggtttggtttaggggtttttaaactttttaccggtaaagggtttttaaacgttacgttttaccggttaacgggggtttttaccccgggggggggttttttacgggaccgggggttaaaccgggggtaaacccgtaaaacgggttacccggttacgggtaaacccccggttaccgtttaaaccgggggtaccgtacccgggtaacccccggtaaaacggggtcccgttaacccggtacccccccggtttaccggggtcccctaaacccgtttccccggtttaccggttttacccccccgtaacccccccg

SEQ ID NO: 359796 - DNA, 727 bp, Homo sapiens
  misc_feature: GZ8MTXP02G2LLQ.10.80.H03.1.454.CMB.2.raw
  modified_base (227)..(227): a, c, t, g, unknown or other
  misc_feature (227)..(227): n is a, c, g, or t
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataaccgtggtggggganacagcattgaaagtgaagctgtccactggtaccagcagaggccaggccaggcccctgtactggtcctntangatgatgtcgacccgcctagaggactccgtagacgccgtattctcgtcgtcctaccaacgtcggtacgggaaccgacccggacccacccgtacgaaccctaacgtacccgaaaccggtaacgggggtaccggaaacggggccgggggtaacgtacggggaccggtaccgtaacgtttaagttacgttgtacggtagggttgttaggtttacttacgtaaggttaacgttacgttacggttacgggggtttccgggggtttacgggacggggtaacggggtaacgttaacgggtccgttaccggtaacccggttaccggttacggggtaccgaacccgggaccccgtaaacggggtccctaacccgggtccccccgttaccgggtacctaccccgtttaccgttaccccggtttaccccctaaccccccg

SEQ ID NO: 359797 - DNA, 710 bp, Homo sapiens
  misc_feature: GZ8MTXP02JOZN5.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgccaccctcggtgtcaggtcggccccaggagagacggccaggataaccgtggtgggggagacagcattagaaagtgaagctgtccactggtaccagcagaggccaggccacggcccctgtactcggtcctctatgatgtatagtcgacccggccctcgagggactcccgtagacgtccgtattcctcgtcggtcctaccctaaactcggtacgggaaaccacccgggacccacctcgaacccactacccgaaccggtacggggtaccgaacgggcccggggtaagtcggaacgggccgtaaacgttagttacgttgtacgtagggttaggttaggttatttcgaagtttagttaacttcgtaacggggtttccgggggtttacggacggggtaacggggtaaccaaaagggtacgtaccgggtacccgttaccggttaacgggaccgtaccggaccccggtaaacggtcccgtaaccccggtcccccctttccggggtaccctaacccgtttccgttccccgggtttaccccccctccccg

SEQ ID NO: 359798 - DNA, 551 bp, Homo sapiens
  misc_feature: GZ8MTXP02I8QEQ.10.80.H03.1.454.CMB.2.raw
  modified_base (365)..(365): a, c, t, g, unknown or other
  misc_feature (365)..(365): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggccccctgtactggtcctctatgatgatagtgacccggccctcagggatccccgtgacgccgtattctctggctccaactctaggggaacncggtcccaccctgacccatccaccgaggtcgaagccggggatgaggccgactatactgtcaggtgtggtattcgagttagtattcgagttccgggggttttgcgggtagggacaaggtctggaccgtcgtaggtccacgaccccaaggcctcgccccctggtccacgttcctcgttccctaccccc

SEQ ID NO: 359799 - DNA, 702 bp, Homo sapiens
  misc_feature: GZ8MTXP02JCHTK.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctttcactgcacagcctctgcgacctcctatgtgctgtctcagccaccctcggtgtcagtggcccaggagagacggccaggataacctggtgggggagacagcattagaagtgaagctcgtccactggtaccagcagaggccacggccgacggccccctgtactggtcctactagtgatgataggtcgaccccggccctgagggactccctgagcgtacttcctcgtcggacctccaacgttccgtgggggaaacctacccgggcccacccccgttagaccctaactcccgaaaccgggacgggggtaccggaaaccgggaccgggggacgttacggacgggtacccggtaactttaagtttaactggtacgtaggggttaggttaggttacgttttacgtaaggttagtttacgttacggtacgggtttcccggggggtttacgggacgggaacggggtacccgtaaggccgttacggacccgttaccggtcggtacgaccggacccgaacgggtccctcccggaacccccgtcgggtacctacccgttcgtccccgtcccgtacccccttcccg

SEQ ID NO: 359800 - DNA, 757 bp, Homo sapiens
  misc_feature: GZ8MTXP02IRJQF.10.80.H03.1.454.CMB.2.raw
  modified_base (324)..(324): a, c, t, g, unknown or other
  misc_feature (324)..(324): n is a, c, g, or t
  modified_base (337)..(337): a, c, t, g, unknown or other
  misc_feature (337)..(337): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtgggggagacagcattgaaagtgaagctgtccactggtaccagcagagccagccaggcccctgtactggtcctctatgatgatagtcgaccgcctgagggactcccngacgccgtattcncgtcggctacccaactcgtacgggaaacctaccggaccctaccctacgaccctactacccgaaccggaacggggtacccggaaacgggcccgggggaaacgtacgggaaccggggtacccggtaaaccgttaagtttacgttacggtaccggtaaagggggtttgggttagggttttaacgtttaccgtaagggtttaaagtttaacgtttaccggttaacggggtttcccgggggggtttttaccggggaccgggggttaaaccgggggaacccgtaaaacggtcccggttacggtaaccccgggttaccgttaaacggggttcccgaaccgggtacccccgtaaacgggtcccgtcccgtaccccccgttacgggttacccacccgtttccgttacccggtttccccctaaccccccg

SEQ ID NO: 359801 - DNA, 743 bp, Homo sapiens
  misc_feature: GZ8MTXP02GWH11.10.80.H03.1.454.CMB.2.raw
  modified_base (227)..(227): a, c, t, g, unknown or other
  misc_feature (227)..(227): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataaccgtggtggggganacagcattagaaagtgaagctgtccactggtaccagcagaggccaggccacggcccctgtactggtcctctatgatgatagtcgacccggcctcgacgggactcccgtggacgccgtattcctcgtcggcctaccaaactcgtacggggaaaccaccgggaccccaccccgtagaaccctactacccgaaccggtaacggggtaccgaaacgggcccgggggatacgggaaccgggcccgtaaacttaagtttacgttcgtacgtaggggttagttagggtttaatttcgaaggtttagttacgtttacggtaacggggtttcccggggggttttacggaccggggtaacggggtaacccgtaaacgggtccgttacgggtaaccccggtttacccggttaaacgggttacccgaacccgggtaccccgtaaacggggtcccttaaccccgggtcccccccgttcgggttacccctaccgtttccccggtttcccggtttaccccccgtccccccg

SEQ ID NO: 359802 - DNA, 724 bp, Homo sapiens
  misc_feature: GZ8MTXP02HGYWG.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtgggggagacagcattgaaagtgaagctgtccactggtaccagcagacggccaggccaggcccctgtacctggtcctctatgatgatagcgacccggccctcgacgggactccccgtaggacgtcccgtacttccgtcgtcggtcctaccctaaaccgttcgtacggggaaaccacccggggtccccaaccccgttcggaaccctaacgtacccgaaacccggtacgggggtaccggaaacggggcccgggggtaatacgggaccgggacccgtaacgtttagttaacgttcgtaccggtagggtttaggtaggtttaacgtttacgtaggttaacgttaacgtttccgtaacggggtttcccggggggttttacggacggggtaacgggtaccgtaaacggtcgtaccggtacccggttaccggtaacggtccgaaccgacccgaaggtcccgtaaccgtcccccgtacggtcctaccgtccgtttcccgttaccccctacccccg

SEQ ID NO: 359803 - DNA, 668 bp, Homo sapiens
  misc_feature: GZ8MTXP02I1WW6.10.80.H03.1.454.CMB.2.raw
  modified_base (236)..(236): a, c, t, g, unknown or other
  misc_feature (236)..(236): n is a, c, g, or t
  modified_base (324)..(324): a, c, t, g, unknown or other
  misc_feature (324)..(324): n is a, c, g, or t
  modified_base (327)..(327): a, c, t, g, unknown or other
  misc_feature (327)..(327): n is a, c, g, or t
  modified_base (357)..(357): a, c, t, g, unknown or other
  misc_feature (357)..(357): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgccgacctcctatgtgctgtctcacgcccacccgtcggtgtcaggtcggcccgaggagaggacggccaggactaaccgtgggtaggggganacagactagttaggaaaggtgaagtctcgtacccacgtacggtaccagcgaggacggccgacggccacggcccctgtactcggtcctntangatgatggcgacccgcctagacggctccgngacgccgtacttctcgtcgcctaccgtactcggtacggaaccaccggcccaccgtcgaacctactacccgaccggagggtacggaacggggcggggtagtacggaccggtactaacttagttacgtcgttacggtaggtttggttagtttagtttacgtaaggtttacgtacgttcgggttacggggtttccgggggttacggacgggtacgggtacgacgtcggtcgtaacccggtcgtacggtccgacgtacccgacggtcccgtaacccgtcccgtcggtacctccgtacgttcccctccccgtaccc

SEQ ID NO: 359804 - DNA, 717 bp, Homo sapiens
  misc_feature: GZ8MTXP02IYR6B.10.80.H03.1.454.CMB.2.raw
  modified_base (226)..(226): a, c, t, g, unknown or other
  misc_feature (226)..(226): n is a, c, g, or t
  modified_base (380)..(380): a, c, t, g, unknown or other
  misc_feature (380)..(380): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggcccaggagagacggccaggataaccgtggtggggganacagcattgaaagtgaagctgtccatggtaccagcagaggccaggccacggcccctgtactggtcctctatgatgatagtcgacccggcctcgacgggtactcccgtgacgccgtattcctcgtcggtctacccgtaactcgtacgggaaaccnccgggacccaccccgtgaaccctactacccgaaccgtacggggtaccggaaacggggacccgggggtagtacgggacggggtacccgtaacgttacgttaacgttggttacggtaggggtttggttacgggtttagtttaccggtaaggtttacgttacgtttcggttaacggggtttcccggggggttttacgggccggggtaacggggtaacccgtaacggtcggtaccggtacccggttacgtaacgggtccgtaaccggaccccgaacggtccgtaacccggtccccccgttacggtccctaccgtttcccgttcccggttcccccgtccccg

SEQ ID NO: 359805 - DNA, 712 bp, Homo sapiens
  misc_feature: GZ8MTXP02FMVPN.10.80.H03.1.454.CMB.2.raw
  modified_base (293)..(293): a, c, t, g, unknown or other
  misc_feature (293)..(293): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtgggggagacagcattgaaagtgaagctgtccactggtaccagcagaggccaggccaggcccctgtactggtcctntatgatgatgtgacccggcctcgagggactcccgtagacgccgtatttccgctcgggcctacccaaacgttccgtacggggaaaccaccggggaccccaaccccgtagaacccatacccaacccgtagggggtaccgaaacgggcccgggggatacgggaacgggccgtaacgttaatttacgttgttacgtagggttgttagggtattttacgaaggtttagttacgtttccggtaacggtttcccggggggttttacggacggggtaacggggtaaccctaaaggtccgttacgggacccggttacccgtaaggggttacccaaccgggtaccccgaaacgggtcccgtaaccggtcccccccgttacggggttaccctacccggtttccgtttacccggttcccccttaacccccg

SEQ ID NO: 359806 - DNA, 601 bp, Homo sapiens
  misc_feature: GZ8MTXP02I6FYH.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacgggccaggataacctggtgggggagacagcattgaaagtgaagctgtccactggtacagcagagccgaggccacggccccgtcgtactcggtcctctactgatgataaggtcggacccggcccgtcgagggtactcccgtgtacgcgtacttctctggtcctccaactcgtgggaaccaccggcccaccctgacgactccaccgtaggcgaagccggggatgacggcgtaactattatcgttgaggttgtaggttatttcgagttaagtacttcgtaaggttccgggggttttacggcgggaagggtacgaacgtcgtcggtaaaccgtccgttaggacaccggaccgaaacggtcgtccgcccccgttacggtctaccgtccttcgttacccctccccc

SEQ ID NO: 359807 - DNA, 635 bp, Homo sapiens
  misc_feature: GZ8MTXP02JH18C.10.80.H03.1.454.CMB.2.raw
  modified_base (437)..(437): a, c, t, g, unknown or other
  misc_feature (437)..(437): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataacctggtggggagacagcattagaaagtgaagctgtccacgtggtaccagcagagccgaggccacgcccctgtactcggtcctctatgatgataggcgaccccggcctcgaggacctcccgtgacgcccgtattcctctcggtcctaccaactcgtacgggaaaccaccggccctacccgtacgaacctactaccaccgacggggtaccgaagggcccggggtancggacggccgtaacttattagtcgtcgtaggtgttacggtattacgtaggttagtacttcgtacgggtttccgggggtttacggcggtacgggaccgtaagtccgtacggtacccgtcggtaacggtccgaccgacccgtaacggccgtaacccggcccccgtacggttaccacccgttccgtcccgtacccctcccg

SEQ ID NO: 359808 - DNA, 747 bp, Homo sapiens
  misc_feature: GZ8MTXP02JVIOZ.10.80.H03.1.454.CMB.2.raw
tcagcatagtagtgcacgaccggtgctcgatttagctgtgcgtcgaagggaaaggggctgggcctaagtaagcagcactggtggtgcctcagccatggcctggaccgttctcctcctcggcctcctctctcactgcacagcctctgcgacctcctatgtgctgtctcagccaccctcggtgtcagtggccccaggagagacggccaggataaccgtggtgggggagacagcattgaaagtgaagctgtccactggtaccagcagaggccaggccaggcccctgtactggtcctctatgatgataggtcgacccggcctcgagggactcccgtggagcccgtattctcgtcggcctacccaaacgtccgtacggggaaaccaccgggcccacccgtcgacccactacccgaaccggtaaggggtaccggaaacgggccccgggggtaatacgggggaaccgggacccgtaaacgttacgtttaagttcgggtaccggtagggggtttaggttacggggtttaaatttttaccggaagggtttaaacgttaacgtttccggtaacggggttttcccggggggggttttacggacgggggttaacgggggaaccctaaacgggtccgttacgggaaccccggttccggtacgggttacccgaaccggaccccgtaaacggggtccctaaccggtcccccccgttcgggttacccaccgtttccgtttccccggtacccccttaccccccg

SEQ ID NO: 359809 - DNA, 616 bp, Homo sapiens
  misc_feature: GZ8MTXP02IJJJ0.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtgggggagacagcatgaaagtgaagctgtccactggtaccagcagaggccaggccacggcccctgtactggtcctctatgatgataggtgacccgggccctcgagggctcccgtgagccgtattcctcgtggcctacccaactcgtacggggaactaccggcccaccctgaccatcaccagggtacgaacggccgggatgacggacgacgtattagttgtacgtaggtggttggttatttcgagttaagttattacgtacggtttccgggggtttttcggcggggtaagggaccgaaaggtcgtacgacccggtccgttaaacggcgtacggacccgaacgggtccctccgaccccccgttcggtcccgtccgttcccgtccggttcccccgtcccccg

SEQ ID NO: 359810 - DNA, 688 bp, Homo sapiens
  misc_feature: GZ8MTXP02G6Y0F.10.80.H03.1.454.CMB.2.raw
  modified_base (329)..(329): a, c, t, g, unknown or other
  misc_feature (329)..(329): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtcgacccggccctgagggactcccgngacgccgtattcctcgtcggcctaccaactcgtacgggaaaccaccggcccacccgtacgaccctatcccgaaccgaggggtaccgaacggccggggatggacggccgacgttagttattgtacagggttgtaggttatttacgagtttaacgtagttcgtaacgggtttcccgggggttttacggaccggggtaacggggtacccgtaaagggtcccgttacgggaaaccccggttccggtaaacgggttcccgtacgggtacccccaaacggggttaccctcccgggtcccccccgttcggggttacccctaaccccgtttccccggtttaccccccgtaacccccgtttacccccg

SEQ ID NO: 359811 - DNA, 673 bp, Homo sapiens
  misc_feature: GZ8MTXP02FHGLO.10.80.H03.1.454.CMB.2.raw
  modified_base (292)..(292): a, c, t, g, unknown or other
  misc_feature (292)..(292): n is a, c, g, or t
  modified_base (340)..(340): a, c, t, g, unknown or other
  misc_feature (340)..(340): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtgggggagacagcattgaaagtgaagctgccactggaccagcagaggccaggccaggccccctgtactggtcctntatgatgatagtgacccggccctgagggactccgtgagcccgtattcnctgctacccaacgtcgaggggaacaccggcccaccctgaccataccaaccgacgggtacggaaaggccgggggatacggacggaccgaacttattagttgtacgtagggtggttagggttatttacgtaggttaagttacgtttacggtaacgggtttcccggggggttttcgggacggggtaacggggtaaccgaaaacggtccgtacggtaacccggttcccgttaaacgggttaccgtaaccggaccccgaaacgggtcccgtcccggtacccccccgttcgggtaccctaacccgtttacccgttcccggttacccccttaaccccccg

SEQ ID NO: 359812 - DNA, 690 bp, Homo sapiens
  misc_feature: GZ8MTXP02F9FN5.10.80.H03.1.454.CMB.2.raw
  modified_base (230)..(230): a, c, t, g, unknown or other
  misc_feature (230)..(230): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgcccacccgtggtgtcaggtcggcccgaggagaggacggcaggactaacgtgggtgggganacagctataggaagtgagctcgccagtcggaccagcgagacggccgacgccgaccggcccctggtaccgtcggtcctactatggtataggtaatacgggtaccggaccccgggtcccgtacggacggggtaccttcccggtaggacgtcccgtacttccgtcgtcggtacctaccgtaacgtccgggtaacgggaacccacccggtacccctaaccgacgtaacccgactacccggaacggtacggggtacggaacgggcgggtaagtacggaccgtacgtacttaagttacgttggtacggtaggttggttacgttagttacgtaggttacgttcgttacggttacggggttccgggggttacggcgggaacgtacgacgtcgcggtaccgtcgacggcgacgacccgacggtccgtcccgaccccgtgtacccgtcgttccgtcccgttcccctaccc

SEQ ID NO: 359813 - DNA, 735 bp, Homo sapiens
  misc_feature: GZ8MTXP02FI1U5.10.80.H03.1.454.CMB.2.raw
  modified_base (227)..(227): a, c, t, g, unknown or other
  misc_feature (227)..(227): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataaccgtggtggggganacagcattagaaagtgaagctgtccacgtggtaccagcagaggccaggccacggcccctgtactggtcctctatgatgatagtcgacccgcctcgaggctccgtgagccgtattctctcggcctacccaacttccgtacggggaaaccctaccgggacccctaccccgtagaccctaactaccgacccgtacggggtaccggaaacgggtcccgggggaagtacgggacggtacccgtaaacttacgttagttcggtacgtaggggttggttaggttatttacgtaagggtttagttacgtttacgtacgggggttttacccggggggttttacggggaccggggtaacgggggtaacccgtaaaacgggtcccggttaccggtacccggttacccggtaacgggttaccgaacccggtaccccgaacgggtcccgtaaccccggtccccccgtttaccggggtaccctacccgtttcccgttaccccggttccccccgttccccccg

SEQ ID NO: 359814 - DNA, 761 bp, Homo sapiens
  misc_feature: GZ8MTXP02GV62J.10.80.H03.1.454.CMB.2.raw
  modified_base (266)..(266): a, c, t, g, unknown or other
  misc_feature (266)..(266): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacggccaggataaccgtggtgggggagacagcattagaaagtgaagctgtccatggtaccagcagnggccaggccacggcccctgtacgtcggtcctctatgatagataggtcgacccggcctcgacggtactcccgtagacgcccgtactttccgtacgtcggtaccctacccgtaaacgtccggttaacggggaaacccaccggggacccccctaaccccgtacgaaacccctaacgttaccccgaacccggtaacgggggtacccgaaaacgggggacccgggggtaatacggggaaccgggtacccgtaaaccgtttagtttaaccgttaggtaccgttaggggttagtttacgggttaactttccggaaaggtttacgttacgtttacggtaacggggtttcccgggggttttcggacggggtacggggtaccctaaacgggtccgttacggtacccggttaccggttacgggtaccaccgggtacccgaacggtcccgtaacccggtcccccgttacggtccctaccgttccggttcccgtttcccccgtccccc

SEQ ID NO: 359815 - DNA, 673 bp, Homo sapiens
  misc_feature: GZ8MTXP02JYYFS.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggactaaccgtggtagggggagacgagcagttagaaagtgaagctgtccactggtaccagcagacggccaggccacggcccctgtactggtcctctagtgatgataggcgacccggccctacgagggactcccgtgacgccgtacttctcgtcggcctaccacgtcgtacgggaactacccggccaacccgtgaacccactacccgaccggaacggggtaccgaaacggggccgggggaagtacggaccggggccgtaacgttacgtttagttcgtaaccggtagggtttggttaggttacgttttacgaaggtttaagttactttccggtacgggttttccgggggggtttacgcgggggtaacggtaccgaaggtccgtacggtacccgtacggtacggtcgaccgaccggtaaccgtcgtcccgacccccggttcggacctacgtccctccgttacccctcccc

SEQ ID NO: 359816 - DNA, 685 bp, Homo sapiens
  misc_feature: GZ8MTXP02H08FA.10.80.H03.1.454.CMB.2.raw
  modified_base (230)..(230): a, c, t, g, unknown or other
  misc_feature (230)..(230): n is a, c, g, or t
  modified_base (314)..(314): a, c, t, g, unknown or other
  misc_feature (314)..(314): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgcccaccctcggtgtcaggtcggcccaggagagacggccaggataaccgtgggtagggganacgagacattaggaagtgaagctgtaccagtggtaccgagacgaggacggccgacggccacggcccctagtaccgtcggtcctntagtgaagtgaagttacggtaccggacccggtcccgtacggacggggtacctcccgtggacgtccgtactttccgtcgtacggcctaccgaacgttcggtacgggaacacccggcccaccgtacgacctacgtaccgaacggacggggtacggaaacgggccggggaagttcggaacggtccgtaacgttaatttacgtggtacgtaggttggtttaggtttatttacgtagttaagttcgttagggtaccgggttttcgggggttcgacggggtacggacgtacgcgtacgtacgttacgtacggacgaccgaccgtacggccgtcccggtccccgtaggtaccctacgttccgtcccgtttcccgcccc

SEQ ID NO: 359817 - DNA, 772 bp, Homo sapiens
  misc_feature: GZ8MTXP02HKF7Q.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcaaagcctctgcgacctcctatgtgctgtctcagcccaccctcggtgtcagtcggcccaggagagacggccaggactaaccgtggtggggagacagcatagaaagtgaagctgtaccacgtggtaccaggacaggacggccgacggcccgacggcccctagtacgtcggtcctcgtatcgatgatacgtcggacccggtccctacggacgggtacctcccgtaggacgtcgtaccgtttccgtccgtcggtcctacccgtaaacgttcggtaccggggaaaccacccgggacccctacccccgtacggaccctaacgtaccccgaaaccgggtacggggaaccggaaaaccggggtccgggggaaacgtcggggaaccggaccccggttaaacgtttagtttaaccggttggtaccggtaaggggtttggtttaaggttacgttttagaacggtttagttaaccgttcgggttaacggggtttccggggggtttaacggcggggttaaacgggtaacctaagggtccgtaacgggtaccccgttaacggtacgggtacccgaaccgtaccggaaccgtccgtacccgcccccgttcggtaccctccgtccctacccgtccccctaaccccttccccg

SEQ ID NO: 359818 - DNA, 792 bp, Homo sapiens
  misc_feature: GZ8MTXP02GW65N.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgcccacccgtcggtcgtcgaggtcggccccgaggagaggaccggccaaggacttaaccgtgggtagggggagacagactagttaggaaagtgaagtctacgtaccacgtacggtaaccaggacgaacggacgggacccacggcccgaaccggtcccccgttaggtaccgttcggtcccttacgttagtagtagtagtagttacggtccggaaccccggtccccgtacggacggggtaacctccccggtaggtacgtacccgttacgtttccgtccgtccggtacccttaacccgtaaaccgttcccggggtaaaccgggaaaccccgacccgggaccccctaccccgtacgaacccctacgtacccgaaccgggaacgggggtaccggaaaccggggccgggggtaagcgggaacccggtaccgttaactttaagttacgttacggtacggtagggttgttacggtttattacgtaggttagttacgttacggtcggggtttaccgggggttacggacgggtaacggacgtaaggtccgtacggtaccgttccgaaggtaccgaccgacccgaagtcccgcccgtacccgtcgtacctcgttcccggtcccgttcccgtcccc

SEQ ID NO: 359819 - DNA, 702 bp, Homo sapiens
  misc_feature: GZ8MTXP02IXKOX.10.80.H03.1.454.CMB.2.raw
  modified_base (227)..(227): a, c, t, g, unknown or other
  misc_feature (227)..(227): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcaggtcggcccaggagagacggccaggataaccgtggtggggganacagcattagaaagtgaagctgtccactggtaccagcagaggccaggccacggcccctgtacctggtcctctatgatgatagtcgacccggcctcgacgggtactcccgtaggacgtccgtattccgtacgtcggtacctacccaaacgttccggtacggggaaacccaccgggacccccaccccgttacggaccctaactacccgaaaccgaacgggggtaccgaaacggggcccgggggtaatacgggaccgggtacccgtaactttaagttacgttggtacgtaagggtttggttagggtttactttcgtaaggttacgttagtttacggtacgggtttccggggggttttacggcggggtaacgggaccgtaaggtccgttacggtacccggttcgtacggtacgaccggacccgaaggtccctccggtcccccgttcggtacctccgttccgttcccggtacccctcccc

SEQ ID NO: 359820 - DNA, 670 bp, Homo sapiens
  misc_feature: GZ8MTXP02I5ZXM.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgccaccctcggtgtcagtcggccccaggagagacggccaggactaaccgtggtgggggagacagcattagaaagtgaagctgtccacgtcggtaccagcaggacggccgaggccacggcccctgtacctcggtcctctactgatgatacgtcgacccggcctcgagggactcccgtgacgccgtacttcctcgtcggtcctacccaactcggtacgggaaaccacccggacccacccgtacgaaccctactacccgaaccggtacggggtacggaacggggcccggggagtacggacggtaccgtacgttagttacgttgtacgtagggttgttaggttatttacgtagttacgttattcggtacggtttccgggggttttacggcggggtacggaccgtaagtcgtcggtacccgttccgtaaggtccgaacgacccgaacggcccgttcccgcccccgttcggtaccctaccttcccgtcccgttcccccttacccccg

SEQ ID NO: 359821 - DNA, 761 bp, Homo sapiens
  misc_feature: GZ8MTXP02FOMIS.10.80.H03.1.454.CMB.2.raw
  modified_base (225)..(225): a, c, t, g, unknown or other
  misc_feature (225)..(225): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggcccaggagagacggccaggataaccgtggtgggganacagcattagaaagtgaagctgtcccagtggtaaccagcagaggccaggccaggcccctagtactcggtcctctatgatgatagcgacccggccctgacgggtctccgtgacgccgtacttctgtcggcctacctaactcgacgggaaacctacccggacccacccgtacgaacccactaacccaaccggtacggggtaccggaaacgggcccgggggaagtacgggaaccgggtaccgtaaacgtttaacgtttaaaggttcggtaccggttaaggggtttacgggttaggtttaaccgttttagtaaacggtttaacgtttagttaccggttacgggggtttacccggggggtttttacggaccggggtaaacgggggtaacctaaaacgggtcgttacccgggtaccccgttaaccggttaacgggtacccgtacccgggaccccgtaaccggggtcccgttccccgggtaccccccggttccggttaccttaaccccgtttccgtacccccgtttacccccctaaccccccg

SEQ ID NO: 359822 - DNA, 633 bp, Homo sapiens
  misc_feature: GZ8MTXP02H7OYC.10.80.H03.1.454.CMB.2.raw
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtcggccccaggagagacgggccaaggactaaccgtggtagggggagacagcattagaagtgaagctgtccactggtacagcaggagccaggccaggccccctgtacctggtcctcgtagtcgatcggtataggtcgacccgggcctcgacgggtactccgtggagtccccgtattcctcgtcgtcctaccgaccttcgtggggaacccctaccggggccctaacccctcggaaccactcccgaaacgacgggttaccgaaggggacccggggatacggacggtaccctagttaattacgttgtcgtaagggtgttacgtttagttgtacgtagtttacttcgtacggttcgggggtttacgcggagtaccgagccgtagaccgtccgttaggcacgaccacggtcctaaccggcccttacgggtcacctttcgtaccgtccccgtccc

SEQ ID NO: 359823 - DNA, 662 bp, Homo sapiens
  misc_feature: GZ8MTXP02GLUOE.10.80.H03.1.454.CMB.2.raw
  modified_base (232)..(232): a, c, t, g, unknown or other
  misc_feature (232)..(232): n is a, c, g, or t
  modified_base (631)..(631): a, c, t, g, unknown or other
  misc_feature (631)..(631): n is a, c, g, or t
  modified_base (646)..(646): a, c, t, g, unknown or other
  misc_feature (646)..(646): n is a, c, g, or t
tcagcatagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcacgcccacccgtcggtcgtcacgtcggccccaggagagacggcaggataaccgtggtcggggganacagcgtattagaaagtgaagctgccacgtggtacagcagacgcgacggccacggcccctgactggtcctcgtatcgatcggaatacggttacacccgggcctaggtaacgggacctccccggtagaaccgtcccggtatttccgtcgttcggggaccttaaccgaacgtttccggaaccggggaaacctaccggaccccctaccgtacgaaacccttacaccgaaacccggaggtaccggaaaacggcccgggtaagtacggaccgggaccagttaacgttataggttacgagggttacgtaggtttatttcgaagttacggttactacgtacgggtttccggggttacggacggtacggactaggacgttcgaacgttcgagtcgacgaccgagtcnccgtacccctggacnctccgtccgcctcccc

SEQ ID NO: 359824 - DNA, 487 bp, Homo sapiens
  misc_feature: GZ8MTXP01DOQZY.38.1.A01.1.454.CMB.2.raw
  modified_base (193)..(193): a, c, t, g, unknown or other
  misc_feature (193)..(193): n is a, c, g, or t
  modified_base (346)..(346): a, c, t, g, unknown or other
  misc_feature (346)..(346): n is a, c, g, or t
  modified_base (384)..(384): a, c, t, g, unknown or other
  misc_feature (384)..(384): n is a, c, g, or t
  modified_base (429)..(429): a, c, t, g, unknown or other
  misc_feature (429)..(429): n is a, c, g, or t
tcagtcgatcacgtcacgaccggtgctcgatttagacgtctcatcaggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacacctagcctggtaccatcagaacctggccaggctcccagactcctcatctatgatgcatccacagggccactggtctcccagccaggttcagtggcagtgggtctgggacngagttcactctcacatcagcagcctgcagtctgaagtntttgctagtttattattggtctagctagtatgatcagtgtctcgntctaaccttcggccaggggacacgacttggacaataacgaactgtggcttgcaactaa

SEQ ID NO: 359825 - DNA, 516 bp, Homo sapiens
  misc_feature: GZ8MTXP01D8IOB.38.1.A01.1.454.CMB.2.raw
  modified_base (193)..(193): a, c, t, g, unknown or other
  misc_feature (193)..(193): n is a, c, g, or t
  modified_base (280)..(280): a, c, t, g, unknown or other
  misc_feature (280)..(280): n is a, c, g, or t
  modified_base (313)..(313): a, c, t, g, unknown or other
  misc_feature (313)..(313): n is a, c, g, or t
  modified_base (497)..(497): a, c, t, g, unknown or other
  misc_feature (497)..(497): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagaacaactgcctggtaccatcagaacctggccaggctcccagactcctnatctatgatgcatcccacgagggccagtggtcncccagccaggttcagtcgctaggtgggtctgggaacagtgttcactctacaccatcagcagcctgctagtctagaagttatttgattagtttattagttcgtacagtctagtatgatcgagtcgcctcgatccacgtcggcgaggggacacgacgtaggaacaagttaaaccgaatggtcggcnacctaaccgttaagttccg

SEQ ID NO: 359826 - DNA, 521 bp, Homo sapiens
  misc_feature: GZ8MTXP01DKZZT.38.1.A01.1.454.CMB.2.raw
  modified_base (402)..(402): a, c, t, g, unknown or other
  misc_feature (402)..(402): n is a, c, g, or t
  modified_base (518)..(518): a, c, t, g, unknown or other
  misc_feature (518)..(518): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagcccaccctctcctgcagggccagtcagagtgttagaacaacctagcctggtaccatcagaaacctggccaggcctcccagacctcctcatctatgatgcatcccaaccgagggcccacgtgggtcgtccccagcccaggttcagtcggcaggtgggtctggggaacagtgttcactctcaccatcagcagcctgcagtctagaatntttgctagtttattattgtcagtctagttatgatcgagtcggcctccgatccgaccgttcggccgaggggacacggactggaacaagaaacgaatggtcggctcgactaaccgttntcg

SEQ ID NO: 359827 - DNA, 524 bp, Homo sapiens
  misc_feature: GZ8MTXP01DC0T2.38.1.A01.1.454.CMB.2.raw
  modified_base (207)..(207): a, c, t, g, unknown or other
  misc_feature (207)..(207): n is a, c, g, or t
  modified_base (282)..(282): a, c, t, g, unknown or other
  misc_feature (282)..(282): n is a, c, g, or t
  modified_base (347)..(347): a, c, t, g, unknown or other
  misc_feature (347)..(347): n is a, c, g, or t
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
  modified_base (387)..(387): a, c, t, g, unknown or other
  misc_feature (387)..(387): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctccngcagggccagtcagagtgttaagtaacaacctagcctaggtaccatcagaacctggccaggctcccagactcctnatctatgatgcatccacaggccatggtctcccagccaggttcagtcggcaggtggtctgggaacngngttcactcncacatcagcagcctgcagtctagtaagtnttttgcttaagtttattagttgtacagtcgtagtagtgatcgagtcggccctacgactcaccgttcggcgaggggaccacgaacgtaggaaccaaagttaaacgaacgtgtcggctaggcctaaccgttaagttccg

SEQ ID NO: 359828 - DNA, 522 bp, Homo sapiens
  misc_feature: GZ8MTXP01CJKI2.38.1.A01.1.454.CMB.2.raw
  modified_base (388)..(388): a, c, t, g, unknown or other
  misc_feature (388)..(388): n is a, c, g, or t
  modified_base (519)..(519): a, c, t, g, unknown or other
  misc_feature (519)..(519): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgtagtaacacctgcctggtaccatcagaacctggccaggctcccagactcctcatctatgatgcatcccacagggccacgtggtgccccagccaggttcagtcggcagtgggtctggggaacagtgtcacgtctcaccatcagcagcctgcagtctagaagttntttgacttagtttattattgtcgtagtctagtatgtatcgtagtcggcctccgactcctccgttccggccgaggggacacgtacgtacggaacaaacgttaaacgaacgtggtcggctcgactaaccgttntcg

SEQ ID NO: 359829 - DNA, 493 bp, Homo sapiens
  misc_feature: GZ8MTXP01CZYRR.38.1.A01.1.454.CMB.2.raw
  modified_base (349)..(349): a, c, t, g, unknown or other
  misc_feature (349)..(349): n is a, c, g, or t
  modified_base (361)..(361): a, c, t, g, unknown or other
  misc_feature (361)..(361): n is a, c, g, or t
tcagtcgatcacgtcacgaccggtgctcgatttagacgtctcatcaggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcagggccagtcagagtgttagtaacaacctgcctggtaccatcagaacctggccaggctcccagactcctcatctatgatgcatccacagggccatggctcccagccaggttcagtggcaggtgggtctaggggacnggagttcactcncacatcagcagcctgcagtctgaagtatttgctagtttattattggtcagtcagtatgatcagtggcctcgatcaaccttcggcgaggggacacgcgttaggacaaataaacgaatgtggcttgcaacgtaa

SEQ ID NO: 359830 - DNA, 515 bp, Homo sapiens
  misc_feature: GZ8MTXP01DLFSP.38.1.A01.1.454.CMB.2.raw
  modified_base (195)..(195): a, c, t, g, unknown or other
  misc_feature (195)..(195): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (448)..(448): a, c, t, g, unknown or other
  misc_feature (448)..(448): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttaagtaacaacctagcctggtaccatcagaaacctggccaggctcccagacctcctcatctatgatgcatcccacagggccacgtggtctcccagccaggttcagtggcaggtgggtctgggacnggagttcactcncacatcagcagcctgctagtctagaagtatttgctaagtttattattggtcagtctaagtatgatcgagtcggtcctacgntcaaccttcggccgaggggacacgacttaggaacaaacgtaacgaactggtggcttgccaacgtaac

SEQ ID NO: 359831 - DNA, 515 bp, Homo sapiens
  misc_feature: GZ8MTXP01ENMA6.38.1.A01.1.454.CMB.2.raw
  modified_base (281)..(281): a, c, t, g, unknown or other
  misc_feature (281)..(281): n is a, c, g, or t
  modified_base (314)..(314): a, c, t, g, unknown or other
  misc_feature (314)..(314): n is a, c, g, or t
  modified_base (350)..(350): a, c, t, g, unknown or other
  misc_feature (350)..(350): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (404)..(404): a, c, t, g, unknown or other
  misc_feature (404)..(404): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagaacactagcctggtaccatcagaaacctggccaggctcccagactccncatctatgatgcatccacagggccacgtggtcncccagccaggttcagtggcaggtgggtctagggacngagttccactctcacatccagcagcctgcagtcngtaatntttgctagtttatnttggtcagtctagtatgatcgagtcgcctcgatccgaaccgttcggccgaggggaccacggacgttaggaacaaaacgtaaacgacgtcggtaggccttagccaacgtaac

SEQ ID NO: 359832 - DNA, 524 bp, Homo sapiens
  misc_feature: GZ8MTXP01D043L.38.1.A01.1.454.CMB.2.raw
  modified_base (195)..(195): a, c, t, g, unknown or other
  misc_feature (195)..(195): n is a, c, g, or t
  modified_base (256)..(256): a, c, t, g, unknown or other
  misc_feature (256)..(256): n is a, c, g, or t
  modified_base (273)..(273): a, c, t, g, unknown or other
  misc_feature (273)..(273): n is a, c, g, or t
  modified_base (367)..(367): a, c, t, g, unknown or other
  misc_feature (367)..(367): n is a, c, g, or t
  modified_base (518)..(518): a, c, t, g, unknown or other
  misc_feature (518)..(518): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcagggccagtcagagtgtagaacactgcctggacatcagaacngcagctcccagactccncatctatgatgcactacccaaccgaggggcccacgttgggtcgtacccccaggcccagggtttccaaggtgggctaggtggggtctaggggacnggagtttcactctacaccatcagcagcctgcagtctgaagtatttgactagtttattattgggctaggcagtatgatcagtcgtccctcgactcgtaaccgttcggccgaggggacacgacgttggaacaaataacgactgtaggcttgcnccgtaa

SEQ ID NO: 359833 - DNA, 562 bp, Homo sapiens
  misc_feature: GZ8MTXP01C04QG.38.1.A01.1.454.CMB.2.raw
  modified_base (361)..(361): a, c, t, g, unknown or other
  misc_feature (361)..(361): n is a, c, g, or t
  modified_base (374)..(374): a, c, t, g, unknown or other
  misc_feature (374)..(374): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcagggccagtcagagtgttagtaacaactagcctggtaccatcagaaacctggccaggctcccagactcctcatctatgatgcatcccaccgagggccacgtggtctccccagcccaggttcaggtggctaggtggggtctggggacnggtagttcactcncaccatcagcacgcctgctagtctagtaagttgttgacttagtttattagttggtactagtctagtatgagtcgtaggtcgtccctacgtactccgtaaccgttcgggaccggtaacggggacaacggtacgttacggaaccttaaaacgtaaacgtacgtcggtacgcgttacgaaccgttaacgtc

SEQ ID NO: 359834 - DNA, 634 bp, Homo sapiens
  misc_feature: GZ8MTXP01DWEZC.38.1.A01.1.454.CMB.2.raw
  modified_base (197)..(197): a, c, t, g, unknown or other
  misc_feature (197)..(197): n is a, c, g, or t
  modified_base (373)..(373): a, c, t, g, unknown or other
  misc_feature (373)..(373): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccgaggggganagacgcccaccctctcctgcagggccagtcagagtgttagtaacacctgcctggtaccatcagaaacctggccaggctcccagacctcctcatctatgatgcatccccaacgagggcctacgtggtctccccagccctaggttccagtggactagggtcggggtccgtggggaacngggtactttaccacccttctaccgaaccctaagtcccaagccaacggccctggacctaaggttacttaggaaagtttatttacgtacgtttaagttttaatttagtttcgggtacgtagtacttaagttatagtactagtacggtccgtccctacgtacttcccgtaaccggttcgggaccgaacggggaacctaacggtaacgttaacggaaacttaaaacgtaaacgtacgtggtacgcttacgtaaccttaacgtaag

SEQ ID NO: 359835 - DNA, 532 bp, Homo sapiens
  misc_feature: GZ8MTXP01DI4SG.38.1.A01.1.454.CMB.2.raw
  modified_base (193)..(193): a, c, t, g, unknown or other
  misc_feature (193)..(193): n is a, c, g, or t
  modified_base (359)..(359): a, c, t, g, unknown or other
  misc_feature (359)..(359): n is a, c, g, or t
  modified_base (453)..(453): a, c, t, g, unknown or other
  misc_feature (453)..(453): n is a, c, g, or t
tcagtcgatcacgtcacgaccggtgctcgatttagacgtctcatcatgggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagtaacacctagcctggtaccatcagaaacctggccaggctcccagacctcctcatctatgatgcactacccaccgagggccacgtggtctcccagccaggttcaggtggctaggtgggtctaggggacngtagttccactctacacatcagcagctgcagtctagtaatatttgcttagtttattagttggtctagtctagtatgtatcgagtcgtcctcgtntccaaccgttcggaccgacggggacacggacgttacggaacaaacgtaaacgactggtcgcttcgaaccttaacgtaac

SEQ ID NO: 359836 - DNA, 595 bp, Homo sapiens
  misc_feature: GZ8MTXP01EQLY7.38.1.A01.1.454.CMB.2.raw
  modified_base (283)..(283): a, c, t, g, unknown or other
  misc_feature (283)..(283): n is a, c, g, or t
  modified_base (358)..(358): a, c, t, g, unknown or other
  misc_feature (358)..(358): n is a, c, g, or t
  modified_base (399)..(399): a, c, t, g, unknown or other
  misc_feature (399)..(399): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccacctgtctgtgtctccgaggggagagagcccaccctctcctgcagggccagtcagagtgttagtaacaacctagcctggtaccatcagaaacctggcaggcctcccagactcctnatctatgatgcatcccacgagggccagtggtctcccagccaggttcaggtcggcaggtgggtctggggaacaggngttcactctcaccatcagcagcctgcagtctagaaagtttntttgacttagtttattagttgtacgtagtacgtaagttagtgtacttcgtaggttccggtcccttaccgtactacccgtacccggttaaccggggaccgttaacgggggaacccaacggtaacgtaacgggaaaacgttaaaacgttaaaaccggtaacgtggtaacggtctacggttaccctaaccgttcgttcg

SEQ ID NO: 359837 - DNA, 531 bp, Homo sapiens
  misc_feature: GZ8MTXP01BP8Q4.38.1.A01.1.454.CMB.2.raw
  modified_base (192)..(192): a, c, t, g, unknown or other
  misc_feature (192)..(192): n is a, c, g, or t
  modified_base (280)..(280): a, c, t, g, unknown or other
  misc_feature (280)..(280): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagtaacaacctagcctggtaccatcagaactggccaggctccagactcctnatctatgatgcatccaccagggccagtggtctcccagcctaggttcagtcggctaggtgggtctggggaacaggtcgttcactctcacctatcagcagcctgcagtctagaagtattttgcttagtttattagttgtacagtcgtagtatgatcgagtcggccttccgatccgacccgttcggcccgaggggaccacggacgtggaacgaattaaacggaactggtaacggtctacgcaaccgttgttccg

SEQ ID NO: 359838 - DNA, 507 bp, Homo sapiens
  misc_feature: GZ8MTXP01DXLPZ.38.1.A01.1.454.CMB.2.raw
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagaacaacctgcctggtaccatcagaaacctggccaggctcccagactccnatctangatgcactcccaacgagggccacgtggtctcccagccaggttcagtggcaggtgggtctgggacnggagttcacttcncacatcagcagcctgctagtctagaagtatttgactagtttattattggtcagtcagtatgatcgagtgtcctcgatcaaccgttcggcgaggggacacggacttaggacaaataacgaactgtaggcttagcaacctaa

SEQ ID NO: 359839 - DNA, 582 bp, Homo sapiens
  misc_feature: GZ8MTXP01EDXM8.38.1.A01.1.454.CMB.2.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
  modified_base (435)..(435): a, c, t, g, unknown or other
  misc_feature (435)..(435): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgccaccctctcctgccagggccagtcagagtgttagaacacctagcctggtaccatcagaactggcagctccagactccncatctatgatgcactccacgagggcctacgtggtcgtcccagccgaggttcaggtggcgaggtgggtctaggggacaaggtagttccactctacaccatcacgcacgcctgcagtctagtaatatttgacttagtttattattcgggtactagtntaggttatggtatcgtaaggttcggtacccttaccggacttccgtaacccgtttcgggaccggtaacgggggaccaaccggtaacgttacgggaaacttaaaacgtaaaccggtatcgggtgggccttaggtaacccaacgttaacg

SEQ ID NO: 359840 - DNA, 513 bp, Homo sapiens
  misc_feature: GZ8MTXP01ANETG.38.1.A01.1.454.CMB.2.raw
  modified_base (195)..(195): a, c, t, g, unknown or other
  misc_feature (195)..(195): n is a, c, g, or t
  modified_base (287)..(287): a, c, t, g, unknown or other
  misc_feature (287)..(287): n is a, c, g, or t
  modified_base (429)..(429): a, c, t, g, unknown or other
  misc_feature (429)..(429): n is a, c, g, or t
tcagtcgatcacgtcacgaccggtgctcgatttagacgtctcatcagggggatgaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagtaacaacctagcctggtaccatcagaaacctggccaggctcccagacctcctnatctatgatgcatccacaggcccacgtggtctcccagccaggttcccaggtggcaggtgggtctggggaacaggagttcactctacaccatcagcagcctgcagtctgaagtatttgctagtttattagttgtcagctagtntgatcgagtggccttccgatccaccgttcggccgaggggaccacggacgttggaacaaagtaacgaacgtgtaggctgctaacc

SEQ ID NO: 359841 - DNA, 520 bp, Homo sapiens
  misc_feature: GZ8MTXP01AYA0A.38.1.A01.1.454.CMB.2.raw
  modified_base (195)..(195): a, c, t, g, unknown or other
  misc_feature (195)..(195): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (396)..(396): a, c, t, g, unknown or other
  misc_feature (396)..(396): n is a, c, g, or t
  modified_base (515)..(515): a, c, t, g, unknown or other
  misc_feature (515)..(515): n is a, c, g, or t
tcagtcgatcacgtcacgaccggtgctcgatttagacgtctcatcaggggggaactgactcagttaggacccagacggaaccatggaagcccagcgcagcttctcttcctcctgatactctggccttcccagaaatcactggagaaatcgtgatgacgcagtctccagccaccctgtctgtgtctccgagggganagagcccacccgtctcctgcagggccagtcagagtgttagtaacaacctagcctggtaccatcagaacctggcccaggcctcccagactcctcatctatgatgcatccacagggccagtggtcgtccagtcaggttcagtcggcaggtggtctggggaacaggngttcactcncaccatcagcagctgcagtctagaagtntttgcttagtttattattgtcagtctagtatgatcgagttggcctcgattcaaccgttcggccgaggggaccacggactggaaccaagttaaccgaagtggtaacggctcgacctaacngttcg

SEQ ID NO: 359842 - DNA, 606 bp, Homo sapiens
  misc_feature: GZ8MTXP01ENIT5.38.1.A01.1.454.CMB.2.raw
  modified_base (193)..(193): a, c, t, g, unknown or other
  misc_feature (193)..(193): n is a, c, g, or t
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
tcagtcgatcacgtcacgaccggtgctcgatttagacgtctcatcagggggaggaactgctcagttaggacccagacggaaccatggaagcccagcgcagcttctcttcctcctgatactctggctcccagaaatcactggagaaatcgtgatgacgcagtctccagccacctgtctgtgtctccgagggganagacgccacctctcctgcagggccagtcagagtgtaagtaacaactagcctgaccatcagaaccngccagctccagactcncatctangatgcactcccaacgagggccagtggtctccccgagcctaggttcaggtggactaggttcgggctaaggggacaagggtactttccacttcctacaacccgtatacccaagccaacgtctcgacgtacgtacgtagtaagttagtttagttacttagtttaattattagttacgtagtacgtagtagtagtagtacgtacgtcgtccgtaccgtacgtccgtaaccgtaccggttaccggtacgggaacggtaacgtaacgttaacgttaacgttaaacgtaaacgtaacgtaacggtacgtcgttacgtaacgttaacgtaacg

SEQ ID NO: 359843 - DNA, 581 bp, Homo sapiens
  misc_feature: GZ8MTXP01D1BVB.38.1.A01.1.454.CMB.2.raw
  modified_base (193)..(193): a, c, t, g, unknown or other
  misc_feature (193)..(193): n is a, c, g, or t
  modified_base (564)..(564): a, c, t, g, unknown or other
  misc_feature (564)..(564): n is a, c, g, or t
  modified_base (568)..(568): a, c, t, g, unknown or other
  misc_feature (568)..(568): n is a, c, g, or t
  modified_base (577)..(577): a, c, t, g, unknown or other
  misc_feature (577)..(577): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcagggccagtcagagtgttagaacaactagcctggtaccatcaagaacctggaccaggcctcccgagacctcctacattctatgatcgacactcccaaccgacgggcccctacgttcgggtctaccccgagcccgtaaggttccaggttcggacgtaggtcggggtctaggggaactagtcgtcaactctacaccatcagcacgcctgactagttacgtaggtaagttagttttgagttaagtttatttacgttgtacgtagtctaagtagtagatcgtagtccggtcctcgactccgtaaccgtccggacggaggggacttacggaacgtgaaacaagttaaaccgaatgngtcngacctcttnttcg

SEQ ID NO: 359844 - DNA, 493 bp, Homo sapiens
  misc_feature: GZ8MTXP01DSFM6.38.1.A01.1.454.CMB.2.raw
  modified_base (194)..(194): a, c, t, g, unknown or other
  misc_feature (194)..(194): n is a, c, g, or t
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
  modified_base (317)..(317): a, c, t, g, unknown or other
  misc_feature (317)..(317): n is a, c, g, or t
  modified_base (351)..(351): a, c, t, g, unknown or other
  misc_feature (351)..(351): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (460)..(460): a, c, t, g, unknown or other
  misc_feature (460)..(460): n is a, c, g, or t
  modified_base (493)..(493): a, c, t, g, unknown or other
  misc_feature (493)..(493): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagcccaccctctcctgcagggccagtcagagtgttaagaacaacctgcctggtaccatcagaaacctggccaggctcccagactccncatctatgatgcatccaacngggccacgtggtcnccagccaggttcagtggcaggtggtctagggacngtgttcactctacacatcagcagctgcagtctagtagtntttacgntagtttatattggtcagtctagtatgatgagtcgtctcgatcaacgtcgcgagggacacgtanacggacttaagaaacgatgtggcttgcaacctn

SEQ ID NO: 359845 - DNA, 548 bp, Homo sapiens
  misc_feature: GZ8MTXP01EFOE7.38.1.A01.1.454.CMB.2.raw
  modified_base (256)..(256): a, c, t, g, unknown or other
  misc_feature (256)..(256): n is a, c, g, or t
  modified_base (359)..(359): a, c, t, g, unknown or other
  misc_feature (359)..(359): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccgaggggagagacgccaccctctcctgcagggccagtcagagtgttagtaacaacctagcctggtaccntcagaacctggccaggctcccagactcctcatctatgatgcatcccacagggccagtggtctcccagccaggttcaggtggcgaggtcggggtctaggggacnggtagttccacttctccaccatcagcacgcctgcagtctagtaagttatttgacttaagtttatttagttgggtctagtactagtatgtagtcgtaggtcgtcctacgactccgaacgttcggcgtacgggggacacggaacttacggaacaaacgtaaacgacgtggtaggtcagtccaaccgtaacg

SEQ ID NO: 359846 - DNA, 552 bp, Homo sapiens
  misc_feature: GZ8MTXP01D10MA.38.1.A01.1.454.CMB.2.raw
  modified_base (193)..(193): a, c, t, g, unknown or other
  misc_feature (193)..(193): n is a, c, g, or t
  modified_base (278)..(278): a, c, t, g, unknown or other
  misc_feature (278)..(278): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
  modified_base (370)..(370): a, c, t, g, unknown or other
  misc_feature (370)..(370): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccacctctcctgcagggccagtcagagtgttagaacacctagcctggtaccatcagaacctggccagctcccagactccnatctatgatgcatccacgnggccatggntcccagccaggttcagtcgcagtggtctgggaacagngttcactcctacaccatcagcacgccngctagtacgtagtaagttatttacgacttagttatttaattgttacgtacgtatatagtatcgtacgtacgtacgtccgtcctacgtacctccgtaaccggtcggaccggaacggaccgaacgtaacgaacgaaacttaaacgtaaacgtacgtcggtcgacttacgtaaccgttaacgtcg

SEQ ID NO: 359847 - DNA, 577 bp, Homo sapiens
  misc_feature: GZ8MTXP01D493I.38.1.A01.1.454.CMB.2.raw
  modified_base (195)..(195): a, c, t, g, unknown or other
  misc_feature (195)..(195): n is a, c, g, or t
  modified_base (356)..(356): a, c, t, g, unknown or other
  misc_feature (356)..(356): n is a, c, g, or t
  modified_base (402)..(402): a, c, t, g, unknown or other
  misc_feature (402)..(402): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagaacaacctagcctggtaccatcagaacctggccaggctcccagactcctcatctatgatgcatcccaccagggccacgtggtcgtcccagccaggttcaggtggcaggtgggtctggggacnggtagttcacttctccaccatccagcagcctgcagtctagaagttntttgacttagtttattagttacgggtactagtactaagttagtagtagtacgtaggtccgtcccttaccgacttcccgtaaccgttccggaccggtaacggggaccgaacggtacgttaacggaaacttaaaacgtaaacgtacgtggtacggtacttacgtaaccaacgtaacg

SEQ ID NO: 359848 - DNA, 520 bp, Homo sapiens
  misc_feature: GZ8MTXP01DLZ6L.38.1.A01.1.454.CMB.2.raw
  modified_base (196)..(196): a, c, t, g, unknown or other
  misc_feature (196)..(196): n is a, c, g, or t
  modified_base (355)..(355): a, c, t, g, unknown or other
  misc_feature (355)..(355): n is a, c, g, or t
  modified_base (368)..(368): a, c, t, g, unknown or other
  misc_feature (368)..(368): n is a, c, g, or t
  modified_base (401)..(401): a, c, t, g, unknown or other
  misc_feature (401)..(401): n is a, c, g, or t
  modified_base (445)..(445): a, c, t, g, unknown or other
  misc_feature (445)..(445): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccaggggganagagccaccctctcctgcagggccagtcagagtgttagaacaactagcctggtaccatcagaacctggccaggctcccagacctcctcatctatgatgcatcccacagggccacgtggtcgtcccagccaggttcagtggcaggtgggtctaggggacnggagttcacttcnccacatcagcagcctgcagtctagagtatttgnttagtttattattggtcagctagtatgatcgagtcgtcctccgntccaaccgttcggccgtaggggacgacgacgttaggacaaacgtaaacgaacgtggtaggcttacgcaaccgtaa

SEQ ID NO: 359849 - DNA, 552 bp, Homo sapiens
  misc_feature: GZ8MTXP01BJAV6.38.1.A01.1.454.CMB.2.raw
  modified_base (193)..(193): a, c, t, g, unknown or other
  misc_feature (193)..(193): n is a, c, g, or t
  modified_base (285)..(285): a, c, t, g, unknown or other
  misc_feature (285)..(285): n is a, c, g, or t
  modified_base (360)..(360): a, c, t, g, unknown or other
  misc_feature (360)..(360): n is a, c, g, or t
  modified_base (547)..(547): a, c, t, g, unknown or other
  misc_feature (547)..(547): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcgagggccagtcagagttgttagaacacctagcctggtaccatcagaacctggccaggcctcccagacctcctnatctatgatgcatcccacgagggccagtgggtctcccagcctaggttcaggtcggcaggtgggtctgggaacagngttcactctcaccatcagcacgcctgctagtctagtaagttattttgacttagtttattagttgtacagtctaagttatgtactcgtaggttcggtcccttccggacttcccgaaccgttcggaccgagggggaccacggactaggaaacaacgttaaaacgaacttggcggctcgacctaacgttnttccg

SEQ ID NO: 359850 - DNA, 589 bp, Homo sapiens
  misc_feature: GZ8MTXP01BA6ZY.38.1.A01.1.454.CMB.2.raw
  modified_base (194)..(194): a, c, t, g, unknown or other
  misc_feature (194)..(194): n is a, c, g, or t
  modified_base (442)..(442): a, c, t, g, unknown or other
  misc_feature (442)..(442): n is a, c, g, or t
  modified_base (481)..(481): a, c, t, g, unknown or other
  misc_feature (481)..(481): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccacctgtctgtgtctcgaggggganagacgcccaccctctcctgcagggccagtcagtagtgttagaacaactagcctaggtaccatcaagaacctggaccaggcctcccagacctcctcatctatgatcgcactccacgagggcccacgttgggtctaccccagtccgaggttcaggtcggcgtagggttcgggtctaaggggactaagggtactttccacttcctacacctagtaccagcacgtccgtgacctagttacgtagttaagttnttttgacttaagtttattattggggtactagctagttangtagtcgaggtcgtccctacgtactccgtaaccgtcgggaccgaaggggaccacggtacttaggacaaaacgtaacggcttgggcgcttacgtaaccaagtaaccccc

SEQ ID NO: 359851 - DNA, 583 bp, Homo sapiens
  misc_feature: GZ8MTXP01BOC3J.38.1.A01.1.454.CMB.2.raw
  modified_base (214)..(214): a, c, t, g, unknown or other
  misc_feature (214)..(214): n is a, c, g, or t
  modified_base (294)..(294): a, c, t, g, unknown or other
  misc_feature (294)..(294): n is a, c, g, or t
  modified_base (309)..(309): a, c, t, g, unknown or other
  misc_feature (309)..(309): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccgaggggagagacgcccaccctctccngcagggccagtcagagtgtagaacacctagcctggtaccatcaagaaacctggccaggcctcccagacctcctcatctangatgcactcccacgngggccagtggtctccagcctaggttcaggtggcgaggtgggtctaggggactggtacgttccactcctaccacatccagtcacgcctgactaggtctaggtaacgttattttgacttaagtttattagtttggtactagtctaagtatgattcgtacggttcggtaccctccggtaactccgtaacccggttcgggacccggtacggggaaccaccggtacgttaggaaacttaaacgtaaacggacgtggtcggcttcgaaccttaacgtaac

SEQ ID NO: 359852 - DNA, 590 bp, Homo sapiens
  misc_feature: GZ8MTXP01D1R5F.38.1.A01.1.454.CMB.2.raw
  modified_base (197)..(197): a, c, t, g, unknown or other
  misc_feature (197)..(197): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggganagacgcccaccctctcctgcagggccagtcagagtgtagtaacactagcctggtaccatcaagaacctggccaggcctcccagacctcctcatctatgatgcactcccacgagggccacgtggtctcccagccgtaggttcaggtggctagggtcgggtctaggggactaagggactttccacttctaccactagtcagcagcctgctagtctagtaagttgtttgacttaagttttattagttggtactaggtacttagttatgtaacttcgtaacggttcggtcccttacgtacttccccggtaaccgttccggggaccggtacgggggacctacgggtaaccttaagggaacttaaacgtaaacgacgtggtagccttagccttaactcg

SEQ ID NO: 359853 - DNA, 567 bp, Homo sapiens
  misc_feature: GZ8MTXP01AQHEZ.38.1.A01.1.454.CMB.2.raw
  modified_base (193)..(193): a, c, t, g, unknown or other
  misc_feature (193)..(193): n is a, c, g, or t
  modified_base (281)..(281): a, c, t, g, unknown or other
  misc_feature (281)..(281): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccacctgtctgtgtctcgagggganagacgcccaccctctcctgcagggccagtcagagtgttagaacactagcctggtaccatcagaacctggccaggctccagacctcctnatctatgatcgcatcccaacgagggccacgtggtctccccagcctaggttcaggtggcaggtgggtctagggacnggtgttccactcncaccntcagcagcctgcagtactagtaacgtatttagacttaacttattactggtactaaacgtagtactttaaatcgttatcttacgtacgtttccgggacgggtaacggaccgtaagggtacgaagtacttacgaaaacgtaacgttggttcggactaacggcctaaccgtattcgttacgttcccttcgtaaccc

SEQ ID NO: 359854 - DNA, 747 bp, Homo sapiens
  misc_feature: GZ8MTXP01EDFYO.38.1.A01.1.454.CMB.2.raw
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagcccaccctgtctgtgtctccgaggggagagacgccaccctctcctgcagggccagtcagagtgttaagtaacaactgcctggtaccatcagaacctggccaggcctcccagacctcctnatctangatcgcactcccaaccgacgggccctacgtcggtctaccccagtcccgagggtttccaggttcggacgtaggggttcggggtcctaagggggaactaagggtacgtttcccaaccttccctaccaaacccagttacccgaacggtacccaacgggtcccctagggacccttaaagggtttaccgttaaagggtaaacgttttagtttttacggaccgtttaaaggttttttaaatttacggtttagggtaaccgtaagggttaccttaaagggtttacttaggtaactttacggtaaacggttccgggtacccccttaccggtaaactttcccgtaaaccccggtttcgggaacccggtaacgggggttaaccaaccgggtaacttacgggaaaccttaaaacggttaaaccgacgttgggttcggaccttacggaacccttaaccgtttaag

SEQ ID NO: 359855 - DNA, 574 bp, Homo sapiens
  misc_feature: GZ8MTXP01DTVQ5.38.1.A01.1.454.CMB.2.raw
  modified_base (194)..(194): a, c, t, g, unknown or other
  misc_feature (194)..(194): n is a, c, g, or t
  modified_base (280)..(280): a, c, t, g, unknown or other
  misc_feature (280)..(280): n is a, c, g, or t
  modified_base (286)..(286): a, c, t, g, unknown or other
  misc_feature (286)..(286): n is a, c, g, or t
  modified_base (346)..(346): a, c, t, g, unknown or other
  misc_feature (346)..(346): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagacgccaccctctcctgcagggccagtcagagtgttagaacaactagcctggtaccatcagaacctggccaggctccagactccnatctangatgcatccacagggccatggtctcccagcctaggtcaggtggcaggtggtctagggacngagttcactctcacatcagcagcctgcagtactagtaagtattttgacttaagtttattagtttggtctaggtactaggtattagtaatcgtaacggttcggtaccctccggtactcccgtaacccgtttccgggacccggtaacgggggaaccaaccggtaacgttacgggaaacttaaaacgtaaaacgtaaccgtgtacgggcttacgtaacccgaaccgtaacg

SEQ ID NO: 359856 - DNA, 509 bp, Homo sapiens
  misc_feature: GZ8MTXP01AFBBZ.38.1.A01.1.454.CMB.2.raw
  modified_base (345)..(345): a, c, t, g, unknown or other
  misc_feature (345)..(345): n is a, c, g, or t
  modified_base (506)..(506): a, c, t, g, unknown or other
  misc_feature (506)..(506): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagtaacaacctagcctggtaccatcagaaacctggccaggctcccagactcctcatctatgatgcatccacaggccatggtctcccagccaggttcagtgcagtggtctggaacagngttcactctcacatcagcagcctgcagtctagaagtatttgacttagtttattattgtcgtagctagtatgtatcgagtcggtcctccgatccgaccgttcggccgagggggaccacggtacgtaggaacaaagttaaacgaactgtggctgactaaccgntcg

SEQ ID NO: 359857 - DNA, 580 bp, Homo sapiens
  misc_feature: GZ8MTXP01BP26P.38.1.A01.1.454.CMB.2.raw
  modified_base (193)..(193): a, c, t, g, unknown or other
  misc_feature (193)..(193): n is a, c, g, or t
  modified_base (282)..(282): a, c, t, g, unknown or other
  misc_feature (282)..(282): n is a, c, g, or t
  modified_base (302)..(302): a, c, t, g, unknown or other
  misc_feature (302)..(302): n is a, c, g, or t
  modified_base (385)..(385): a, c, t, g, unknown or other
  misc_feature (385)..(385): n is a, c, g, or t
  modified_base (459)..(459): a, c, t, g, unknown or other
  misc_feature (459)..(459): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagcccacctgtctgtgtctccgagggganagagcccaccctctcctgcagggccagtcagagtgtaagtaacacctgcctggtaccatcaagaacctggccaggcctccagacctctnatctatgatgcatcccacgngggccagtcggtcgtcccaggtccctaggttccaggtcggcgtaggtgggctaggggaaccagtcgttcactctacaaccgtntcacgcacgtctgctagtgtaagtagttagttgtacttagtttattagttcgtacgagtatagtatgtactcgnggtccgtcctaccgtactcccgtccggtcggacggaacgggtaccacggtaacgtaacggaaaaccttaaacggttaaaccgtaacgtcggtaacgtctacgttacctaaccgttcgtccg

SEQ ID NO: 359858 - DNA, 560 bp, Homo sapiens
  misc_feature: GZ8MTXP01EIXZ4.38.1.A01.1.454.CMB.2.raw
  modified_base (194)..(194): a, c, t, g, unknown or other
  misc_feature (194)..(194): n is a, c, g, or t
  modified_base (281)..(281): a, c, t, g, unknown or other
  misc_feature (281)..(281): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccacctgtctgtgtctccgagggganagacgccaccctctcctgcagggccagtcagagtgttagaacacctgcctggtaccatcagaacctggccaggctcccagactcctnatctatgatgcatcccaacgaggggcccacgtggtcgtccccagcccagggtttccaggttgggacagggttcggggtcctaagggggactggtacgtttccaaccttcgtaccacctatccagcagcctgctagtctagtagtatttgacttagtttattagttgggtctagtcagtatgatcgagtcggtcctcgactcaaccgttcggaccgacgggacacggtacgttacggaacttaaacgtaaacgacgtggtcggcttacgccaacgtaacg

SEQ ID NO: 359859 - DNA, 601 bp, Homo sapiens
  misc_feature: GZ8MTXP01EAF9Q.38.1.A01.1.454.CMB.2.raw
  modified_base (193)..(193): a, c, t, g, unknown or other
  misc_feature (193)..(193): n is a, c, g, or t
  modified_base (289)..(289): a, c, t, g, unknown or other
  misc_feature (289)..(289): n is a, c, g, or t
  modified_base (419)..(419): a, c, t, g, unknown or other
  misc_feature (419)..(419): n is a, c, g, or t
tcagtcgatcacgtcacgaccggtgctcgatttagacgtctcatcaggggggaactgctcagttaggacccagacggaaccatggaagccccagcacagcttctcttcctcctgatactctggctcccagaaatcactggagaaatcgtgatgacgcagtctccagccaccctgtctgtgtctccgagggganagagcccaccctctcctgcagggccagtcagtagtgttaagaacactagcctaggtaccatcaagaaacctggaccaggcctacccgagactcctnattctatgatgcactcccaaccgagggcctacgtgggtctcccagtcccaggttcaggtcggcgtaggtgggtctaggggaacaggtcgttcacttcacactatcagcagcctgctagtctagtaagttntttgcttaagtttaattgttgtactaagtctaagttaagtgtaagtccgtaggttccggtacccttacccggattcccgtaacccggttcgggacggttaggggaacccttacggaacgtaagggaaacttaaacggttaaaaccgtcgttgggtgccctaggaccctaaccgtttgttccg

SEQ ID NO: 359860 - DNA, 552 bp, Homo sapiens
  misc_feature: GZ8MTXP01BVOG2.38.1.A01.1.454.CMB.2.raw
  modified_base (193)..(193): a, c, t, g, unknown or other
  misc_feature (193)..(193): n is a, c, g, or t
  modified_base (393)..(393): a, c, t, g, unknown or other
  misc_feature (393)..(393): n is a, c, g, or t
  modified_base (427)..(427): a, c, t, g, unknown or other
  misc_feature (427)..(427): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagaacaacctgcctggtaccatcagaaacctggccaggctcccagactctcatctatgatgcatcccacagggccagtggtcgtccccagcctaggttcagtcggcaggtgggctggggaacagtgttcactctcacatcagcagcctgcagtctagtaagtntttgacttagtttattattgtacagtctaagttntgatcgaggtcgcccttcgaacttccgtccgttcgggccgttaggggaaccacggaacgttcgggaaacttaaacgttaaaccgtaacgtggtaagggccctaggacctaaccgttaagttcccg

SEQ ID NO: 359861 - DNA, 678 bp, Homo sapiens
  misc_feature: GZ8MTXP01ES1I5.38.1.A01.1.454.CMB.2.raw
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (263)..(263): a, c, t, g, unknown or other
  misc_feature (263)..(263): n is a, c, g, or t
  modified_base (277)..(277): a, c, t, g, unknown or other
  misc_feature (277)..(277): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtcctccgagggganagagcccncctctcctgcagggccagtcagagtgtagtaacacctagcctggtaccatcagaaccnggccaggctcccanctcctcatctatgatcgcactccaccgagggcccacgttggtccgtaccccagcctagggttcgacggtcggcgtagggtggggtctagggggactaaggtcgttccacttccgctaacccgatcgacgctacggcccgtagaccgtagtacgtagtaacgttagtttttacggactttaaaggttttttactagtttacggggctacggggttacctaggttaacgttgggtaaacttccggtagggttcccgggtaccccttacccggtaacttccccgtaaccccggtttccggggacccggaagggggttacccaaaccggggtcaaacgggggttaaacttaaaaccggttaaaacgggcttcgggtacgggtccttacggaaccccaacttaacg

SEQ ID NO: 359862 - DNA, 530 bp, Homo sapiens
  misc_feature: GZ8MTXP01BZX4X.38.1.A01.1.454.CMB.2.raw
  modified_base (196)..(196): a, c, t, g, unknown or other
  misc_feature (196)..(196): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggganagacgccaccctctcctgcagggccagtcagagtgtagtaacaacctgcctggtaccatcagaactggcaggctccagctctcatctatggtacatccgtcagggccacgtggtactcccagacaggttcagtggccaggtggtctgggacaagacttcactctcaccatcagcagactggagctagaagtatttgctagtgtattactgtacagggctagtatactaacaagactactactttggccgtagggaccagaacgtggaacgtaaaccaaaccggtaaagtcgttggcttcggaacctactaattctcgttcttcgaacgttcccg

SEQ ID NO: 359863 - DNA, 510 bp, Homo sapiens
  misc_feature: GZ8MTXP01D4X7S.38.1.A01.1.454.CMB.2.raw
  modified_base (192)..(192): a, c, t, g, unknown or other
  misc_feature (192)..(192): n is a, c, g, or t
  modified_base (273)..(273): a, c, t, g, unknown or other
  misc_feature (273)..(273): n is a, c, g, or t
  modified_base (344)..(344): a, c, t, g, unknown or other
  misc_feature (344)..(344): n is a, c, g, or t
  modified_base (409)..(409): a, c, t, g, unknown or other
  misc_feature (409)..(409): n is a, c, g, or t
  modified_base (441)..(441): a, c, t, g, unknown or other
  misc_feature (441)..(441): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagcccaccctctcctgcagggccagtcagagtgttagaacaactgcctggtaccatcagaactgcagctccagactctnatctatgatgcatccaccgaggccacgtggtcgtccagccaggttcagtcggcaggtggtctgggaacagngtcactctcaccatccccagcagcctgcagtctagtaagttatttgacttagtttattattcgtnagtctagttatgtatcgagtcgcctcgatccncgttcggcgaggggacttacgacgtaggaacaacgttaaacgaactgtaagctgaccaacgttaattcg

SEQ ID NO: 359864 - DNA, 653 bp, Homo sapiens
  misc_feature: GZ8MTXP01DHGX2.38.1.A01.1.454.CMB.2.raw
  modified_base (194)..(194): a, c, t, g, unknown or other
  misc_feature (194)..(194): n is a, c, g, or t
  modified_base (495)..(495): a, c, t, g, unknown or other
  misc_feature (495)..(495): n is a, c, g, or t
  modified_base (653)..(653): a, c, t, g, unknown or other
  misc_feature (653)..(653): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctccagaaatcactggagaaatcgtgatgacgcagtctccagccaccctgtctgtgtctccgagggganagacgcccaccctctcctgcagggccagtcagagtgttagaacacctagcctggtaccatcaagaaacctggaccaggcctacccagacctcctcatctatgatcgacactccccgaaccgacggggcccctaacgttgggtccgtacccccgaggtccccgtaagggggtttccaaggggttcgggacgtaaggggtcggggtccgtaagggggaacaaggtacgtttccaacctttcctaccaaccctatcccgaacgccaacggtcccctggacctagggttacctaggtaaagtttntttagacgtttaagttttattagttgggtacagtacttagtatgtagtacgtacgtccgtcctacgtactccgtaacccggtcggaccggagggaccaacggtaacgttaacggaaacaaaacggtaaccgagtggacgcttacgtaaccttaacgtn

SEQ ID NO: 359865 - DNA, 581 bp, Homo sapiens
  misc_feature: GZ8MTXP01D8JWK.38.1.A01.1.454.CMB.2.raw
  modified_base (286)..(286): a, c, t, g, unknown or other
  misc_feature (286)..(286): n is a, c, g, or t
  modified_base (417)..(417): a, c, t, g, unknown or other
  misc_feature (417)..(417): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgccaccctctcctgcagggccagtcagagtgttagtaacacctagcctggtaccatcagaaacctggccaggctcccagacctcctnatctatgatgcatccacgagggccacgtggtctcccagccaggttcaggtggctaggtgggtctaggggacaagggtacgtttccactctacacctagtcagcaggccctggcctagttctagaaagtttntttagacgttaagtttattagttcggtactagtctaagtatagtactcgtacgtcgtccctaccgtactcccgtaaccgtcgggaccggaacggggacctaacggtacgttacggaaacttaaaacgtaaacgacgtggtcggcttacgaaccttaacgtaacg

SEQ ID NO: 359866 - DNA, 504 bp, Homo sapiens
  misc_feature: GZ8MTXP01ARS7H.38.1.A01.1.454.CMB.2.raw
  modified_base (194)..(194): a, c, t, g, unknown or other
  misc_feature (194)..(194): n is a, c, g, or t
  modified_base (283)..(283): a, c, t, g, unknown or other
  misc_feature (283)..(283): n is a, c, g, or t
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
  modified_base (498)..(498): a, c, t, g, unknown or other
  misc_feature (498)..(498): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccacctgtctgtgtctccgagggganagagccaccctctcctgcagggccagtcagagtgtagtaacaacctagcctggtaccatcagaaacctggccaggctcccagactcctnatctatgatgcatccacgagggccagtggtctcccagccaggttcagtggcaggtgggtctagggacngtagttcactcncaccatcagcagcctgcagtcagaagtatttgcttagtttattattggtcagctagtatgatcgagtcgtcctcgactccaaccgttcggccgagggacacggcttaggacaaagtaacgactgtggcttagccncgtaac

SEQ ID NO: 359867 - DNA, 538 bp, Homo sapiens
  misc_feature: GZ8MTXP01CEO25.38.1.A01.1.454.CMB.2.raw
  modified_base (193)..(193): a, c, t, g, unknown or other
  misc_feature (193)..(193): n is a, c, g, or t
  modified_base (286)..(286): a, c, t, g, unknown or other
  misc_feature (286)..(286): n is a, c, g, or t
  modified_base (402)..(402): a, c, t, g, unknown or other
  misc_feature (402)..(402): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagtaacaacctagcctggtaccatcagaacctggaccaggcctcccagacctcctnatctatgatgcatcccaccgagggccacgtggtctcccagccaggttcagtcggcaggtggtctgggaacagtcgtcactctacaccatcagcacgcctgcagtctagtaagtttntttcgattagtttattagttgtactagtatagtatgatcgtagtcgtcctcgtactccgtccgtccggacgacggggacacgtacgtacggaacgttaaacgttaacgaagtgtcgctacgacctaacttgttccg

SEQ ID NO: 359868 - DNA, 536 bp, Homo sapiens
  misc_feature: GZ8MTXP01D9HBH.38.1.A01.1.454.CMB.2.raw
  modified_base (193)..(193): a, c, t, g, unknown or other
  misc_feature (193)..(193): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagtaacaactagcctggtaccatcagaacctggccagctccagactctcatctatgatgacactccaccgagggccacgtgggtctccccagcctaggttcaggtcggacaggtgggtctggggaacagtcgttcactctccacatcagcagctgcagtctagaagttatttgacttagtttattagttgtacagtctaagtatgactcgaggtcggcctcgatccgaccgtcggccgaggggtaccacggtacgtaggaaacttaaagttaacgaagtgtaacggctagacctaacgttaagttc

SEQ ID NO: 359869 - DNA, 720 bp, Homo sapiens
  misc_feature: GZ8MTXP01DQ04V.38.1.A01.1.454.CMB.2.raw
  modified_base (288)..(288): a, c, t, g, unknown or other
  misc_feature (288)..(288): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtcctccgaggggagagagcccaccctctcctgcagggccagtcagagtgttaagtaacaacctagcctaggtaccatcaagaacctggaccaggcctccagcctcctnatctatgatgcactcccacgacggccacgtcggtcgtccccgagcccgtagggttccaggtcggctagggttggggtctagggggaaacctaggtaacgtttccaaacctttccctaccaaaccctagttcgaaacggtccaacggtccccttgggacctaaggttccgttaaagggtaaacggtttatttttgggaactttaaaggtttttaatttaagtttcggtactaaggtacttaaaggttatacggtaattccggtaagggttaccgggtccccttaccgggtaacttccccggtaaccccggtttcgggggaccccggaaggggggaacccttaacgggaaaccggttacgggaaaacccttaaaacgttaaaacccgggtaacgttgggtcggggaccttcggaccctaacccggttcgtttcg

SEQ ID NO: 359870 - DNA, 529 bp, Homo sapiens
  misc_feature: GZ8MTXP01DDJ4D.38.1.A01.1.454.CMB.2.raw
  modified_base (193)..(193): a, c, t, g, unknown or other
  misc_feature (193)..(193): n is a, c, g, or t
  modified_base (282)..(282): a, c, t, g, unknown or other
  misc_feature (282)..(282): n is a, c, g, or t
  modified_base (317)..(317): a, c, t, g, unknown or other
  misc_feature (317)..(317): n is a, c, g, or t
  modified_base (348)..(348): a, c, t, g, unknown or other
  misc_feature (348)..(348): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgtagaacacctagcctaggtaccatcagaaacctggccaggcctccagacctcctnatctatgatgcatcccacgagggcctagtgggtcncccagccgtaggttcagtcgctaggtggtcngggaacaggtcgttcactcacaccatcagcagcctgctagtctagaagttatttgacttagtttattagttgtacagtactagtatgatcgaggtcgccttcgatccaccgttcggcgagggacacgtacgtaggaaacaagttaaacgaactggtcggctacgacctaaccttaagtccg

SEQ ID NO: 359871 - DNA, 562 bp, Homo sapiens
  misc_feature: GZ8MTXP01B5YUV.38.1.A01.1.454.CMB.2.raw
  modified_base (195)..(195): a, c, t, g, unknown or other
  misc_feature (195)..(195): n is a, c, g, or t
  modified_base (362)..(362): a, c, t, g, unknown or other
  misc_feature (362)..(362): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcagggccagtcagagtgtagtaacacctagcctggtaccatcagaaacctggccaggctcccagacctcctcatctatgatgcatcccaacgagggccacgtggtcgtcccagcccaggttcaggtggcaggtggggtctagggggacnggtacttccactctcaccatcagcaggcctgcagtctagtaagtattttgacttagtttattagttgggtctaggtctaaggttatgattcgaggtcggtccctaccggacttccgtaacccgttcggacccgagggggaccacggacttacgggaacttaaacgtaaacgtacgtggtacggcttcggtccaaccgtaa

SEQ ID NO: 359872 - DNA, 525 bp, Homo sapiens
  misc_feature: GZ8MTXP01B3L93.38.1.A01.1.454.CMB.2.raw
  modified_base (195)..(195): a, c, t, g, unknown or other
  misc_feature (195)..(195): n is a, c, g, or t
  modified_base (360)..(360): a, c, t, g, unknown or other
  misc_feature (360)..(360): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcagggccagtcagagtgtagaacactagcctggtaccatcagaaacctggccaggcctcccagacctcctcatctatgatgcactcccacgacgggccacgtggtcgtcccagccaggttcaggtggctaggtgggtctaggggacnggtacgttcactctcaccatcagcagcctgcagtctagatatttgatagtttattagttggtactagcagttatgatcgaggtcgtcctcgatccgtaaccgtcggcgagggacacggtacgttacggaacaaagtaacgagtgtggcttcgaacttaaccgtaa

SEQ ID NO: 359873 - DNA, 602 bp, Homo sapiens
  misc_feature: GZ8MTXP01CYN7Q.38.1.A01.1.454.CMB.2.raw
  modified_base (311)..(311): a, c, t, g, unknown or other
  misc_feature (311)..(311): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctcctgcagggccagtcagagtgttaagaacacctgcctggtaccatcaagaacctggccaggctcccagacctcctcatctatgatcgacactccccaacgngggccacgtggctcccagtccgaggttcaggtcggcgtagggtcgggtactaggggaactggtacgtttcccaccgtctaccaacccgatccgagcacgtcctgctagtctagtaagttattttgacttaagttttatttagttggtacgtagtactaagttatgacttcggtaggtcggtccctccgtactccgtaaccgttcgggaccgaaggggacctaacggtcgttacggaacttaaacgttaaaccggaacgttcggtacggtcttacggaaccttaacgtaacg

SEQ ID NO: 359874 - DNA, 593 bp, Homo sapiens
  misc_feature: GZ8MTXP01B6I0X.38.1.A01.1.454.CMB.2.raw
  modified_base (351)..(351): a, c, t, g, unknown or other
  misc_feature (351)..(351): n is a, c, g, or t
  modified_base (437)..(437): a, c, t, g, unknown or other
  misc_feature (437)..(437): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagtaacaacctgcctggtaccatcagaacctggccaggctcccagactcctcatctatgatgcatcccaccgagggccctagtcgggtctccccagcctaggttcaggtcggcaggtggtcngggaaacagtgtcacctctacaccatcagcagcctgcagtctagaagttattttagacttagtttattagttcgtacgtaacggtntaagtagttagtactaccggtagttccgggcccttccggacttacccgtaaccgttcccgggacccgttaagggggaccaccggtaacgtacggaaacttaaacgttaaaaccgaacgttggtaacgggtactacggacctaaccgttaagttccg

SEQ ID NO: 359875 - DNA, 519 bp, Homo sapiens
  misc_feature: GZ8MTXP01BE6BS.38.1.A01.1.454.CMB.2.raw
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
  modified_base (315)..(315): a, c, t, g, unknown or other
  misc_feature (315)..(315): n is a, c, g, or t
  modified_base (352)..(352): a, c, t, g, unknown or other
  misc_feature (352)..(352): n is a, c, g, or t
  modified_base (512)..(512): a, c, t, g, unknown or other
  misc_feature (512)..(512): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagtaacaacctagcctggtaccatcagaacctggccaggctcccagactccnatctatgatgcatccacagggccacgtggtcncccagccaggttcaggtggcaggtgggtctggggacnggtagttccactctacaccatcagcagcctgcagtctagtaagtatttgacttagtttattagttgggtctagtctagtatgtatcgagtcggtcctcgactcaaccgttcggccgacggggacacgacgttaggacaagtaaacgtactgtggcttgcnccgtaag

SEQ ID NO: 359876 - DNA, 607 bp, Homo sapiens
  misc_feature: GZ8MTXP01EJCF3.38.1.A01.1.454.CMB.2.raw
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (356)..(356): a, c, t, g, unknown or other
  misc_feature (356)..(356): n is a, c, g, or t
tcagtcgatcacgtcacgaccggtgctcgatttagacgtctcatcagggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctcctgcagggccagtcagagtgttagcgaacaacttagcctaggtaccagcaagaacctggccaggctcccaggctcctcatttanggtncatcccgacgacgggccacgtggtctcccagcctaggttcaggtggccaggtgggtcnggggacaagattcactctacaccatcagcagctgcagtctagtaagtattttcgtccctttattactgtacagtactaagttaacttaaactaaccgttcccggtccccccctacgtaccgtttccgggacgggtaacggggtaacccgtaaggggtcgggaacggacttacgaaccgaacggtaaacgtcggttacggttcttacggcctaccgtaacttcgtcgttacctttccgttaacgtttccccg

SEQ ID NO: 359877 - DNA, 542 bp, Homo sapiens
  misc_feature: GZ8MTXP01AU1Z8.38.1.A01.1.454.CMB.2.raw
  modified_base (195)..(195): a, c, t, g, unknown or other
  misc_feature (195)..(195): n is a, c, g, or t
  modified_base (284)..(284): a, c, t, g, unknown or other
  misc_feature (284)..(284): n is a, c, g, or t
  modified_base (361)..(361): a, c, t, g, unknown or other
  misc_feature (361)..(361): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcagggccagtcagagtgttagtaacactagcctggtaccatcagaacctggccaggctcccagacctcctnatctatgatgcactcccaaccgagggccacgtggtctcccagcctaggttcaggtggcaggtgggtcctaggggacnggtacgttcactctcaccatccagcagcctgcagtctagtaagtatttgacttagtttattagttgggtcaggtcagtatgatcgagtcggtcctcgtatccgtaaccgttcgggacgacggggactacggagttacggaacaaacgtaacgacgtggtacggcttacgtccaacgtaacg

SEQ ID NO: 359878 - DNA, 524 bp, Homo sapiens
  misc_feature: GZ8MTXP01AEQM5.38.1.A01.1.454.CMB.2.raw
  modified_base (195)..(195): a, c, t, g, unknown or other
  misc_feature (195)..(195): n is a, c, g, or t
  modified_base (359)..(359): a, c, t, g, unknown or other
  misc_feature (359)..(359): n is a, c, g, or t
  modified_base (399)..(399): a, c, t, g, unknown or other
  misc_feature (399)..(399): n is a, c, g, or t
  modified_base (431)..(431): a, c, t, g, unknown or other
  misc_feature (431)..(431): n is a, c, g, or t
  modified_base (524)..(524): a, c, t, g, unknown or other
  misc_feature (524)..(524): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgtagaacactagcctggtaccatcagaacctggccaggctcccagactcctcatctatgatgcactccaaccgagggccacgtggtcgtcccagccaggttcaggtggcgtaggtgggtcgtaggggacngtagttcactctcaccatcagcagcctgcagtctgaagtntttgacttagtttattattggtcagtctagtntgatcgagtcggcctccgatccgtaaccgttcggacccgaggggccacggacgttcggaacaaagtaacgacgtgtacggcttgccaaccgtn

SEQ ID NO: 359879 - DNA, 534 bp, Homo sapiens
  misc_feature: GZ8MTXP01DVK7T.38.1.A01.1.454.CMB.2.raw
  modified_base (282)..(282): a, c, t, g, unknown or other
  misc_feature (282)..(282): n is a, c, g, or t
  modified_base (407)..(407): a, c, t, g, unknown or other
  misc_feature (407)..(407): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (515)..(515): a, c, t, g, unknown or other
  misc_feature (515)..(515): n is a, c, g, or t
  modified_base (530)..(530): a, c, t, g, unknown or other
  misc_feature (530)..(530): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcagggccagtcagagtgttagtaacaacctagcctggtaccatcagaacctggccaggctccagactcctnatctatgatcgcactcccaaccgagggcctacgtgggtctccccaggcctaggttcagtcggcaggtgggtctggggaacaggtgttccacgttcacaccatcagcagcctgcagtctagaagtntttgcttagtttattattgtcaagtntaagtntgatcgagtcggcctcgtatcctaccgttcgggcgagggggacttacgacgtggaacttaaagttaaacgaactgnggctgacaaccgttntccg

SEQ ID NO: 359880 - DNA, 647 bp, Homo sapiens
  misc_feature: GZ8MTXP01EL4QZ.38.1.A01.1.454.CMB.2.raw
  modified_base (196)..(196): a, c, t, g, unknown or other
  misc_feature (196)..(196): n is a, c, g, or t
  modified_base (455)..(455): a, c, t, g, unknown or other
  misc_feature (455)..(455): n is a, c, g, or t
  modified_base (647)..(647): a, c, t, g, unknown or other
  misc_feature (647)..(647): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcagggccagtcagtagtgttaagtaacacctagcctggtaccatcaagaaacctggaccaggcctcccagacctcctacatctatgatcgcactcccacgacgggccacgtcggtcgtacccagccgtaggttccaggtggcgtagggttcggggtcctaaggggactaaggtacgttccactccctacaaccctagtcccgaagccgacgtcccgtagacctagttcgtaagtaaagttntttttggacttaaggttttaattagttgggtactaaggtctaaggttatggacttcgaaggttcggtacccttaccggaacttcccgtaacccggtttcggacccgggaaacgggggaacctacgggaacgttacgggaaacttaaaacggtaaaccgtacgtggttacggaccttagaaccgttaaccgtn

SEQ ID NO: 359881 - DNA, 599 bp, Homo sapiens
  misc_feature: GZ8MTXP01BEF43.38.1.A01.1.454.CMB.2.raw
  modified_base (439)..(439): a, c, t, g, unknown or other
  misc_feature (439)..(439): n is a, c, g, or t
  modified_base (453)..(453): a, c, t, g, unknown or other
  misc_feature (453)..(453): n is a, c, g, or t
  modified_base (472)..(472): a, c, t, g, unknown or other
  misc_feature (472)..(472): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagcccaccctgtctgtgtctccgaggggagagacgcccaccctctcctgcgacgggccagtcagagtgttagaacactagcctaggtaccatacaagaacctggccaggcctacccagacctcctcatctatgatcgcactcccgacgagggccacgtggtcgaccccagccgtaggttccaggtgggacaggggttcggggtcctaaggggactaaggtacgttccactcctacaccgtatcagcaggcctgcctagtctagtattgtttnacttaagtttattnttggggctagtctaggtangactgtacggtcgtccctcgtactcccgtccggttcgggaccggacggggttaacaacccggtagttacggaaaccaaaacggttaaacccgtacggttggtacggccttacggaacccttaacgtc

SEQ ID NO: 359882 - DNA, 559 bp, Homo sapiens
  misc_feature: GZ8MTXP01D9JQY.38.1.A01.1.454.CMB.2.raw
  modified_base (195)..(195): a, c, t, g, unknown or other
  misc_feature (195)..(195): n is a, c, g, or t
  modified_base (360)..(360): a, c, t, g, unknown or other
  misc_feature (360)..(360): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagtaacaactgcctggtaccatcagaaacctggccaggctcccagactcctcatctatgatgcactcccaccgagggccacgttggtcgtccccagccaggttcaggtggcaggtgggtctaggggacnggagttcaactctacaccatcagcacgcctgcagtctagaagtatttgacttagtttattattggtctagtctaggtatgattcgagtcgtccgtaccgctccgtaacccgtttccgggaccggtacgggggaccaccggacgttaacgggaacttaaacgtaaaacgaacgtggtacggcttcgaaccgaacccgtaa

SEQ ID NO: 359883 - DNA, 552 bp, Homo sapiens
  misc_feature: GZ8MTXP01AKJ9V.38.1.A01.1.454.CMB.2.raw
  modified_base (196)..(196): a, c, t, g, unknown or other
  misc_feature (196)..(196): n is a, c, g, or t
  modified_base (357)..(357): a, c, t, g, unknown or other
  misc_feature (357)..(357): n is a, c, g, or t
  modified_base (437)..(437): a, c, t, g, unknown or other
  misc_feature (437)..(437): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagagcccaccctctcctgcagggccagtcagagtgttagtaacactagcctggtaccatcagaacctggccaggctccagactctcatctatgatcgacactcccacgagggccctagtggtcgtcccagccaggttcaggtggctaggtggctggggacnggtagttccatcctacactatccagcagcctgcgagtcgtagaagttattttgacttagtttattagtttggtctaggtntagtatgattcgagtcggtcctcgactccgtaaccgttcgggaccggtaggggaccacggacgttacgggaacttaaagtaaaccgacgttggtcggacttcgccttaaccgtaa

SEQ ID NO: 359884 - DNA, 571 bp, Homo sapiens
  misc_feature: GZ8MTXP01DJ0RT.38.1.A01.1.454.CMB.2.raw
  modified_base (196)..(196): a, c, t, g, unknown or other
  misc_feature (196)..(196): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (371)..(371): a, c, t, g, unknown or other
  misc_feature (371)..(371): n is a, c, g, or t
  modified_base (404)..(404): a, c, t, g, unknown or other
  misc_feature (404)..(404): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggganagacgcccaccctctcctgcagggccagtcagagtgttaagaacaacctagcctggaccatcagaactggcagctccanactccncatctatgatgcatcccacgagggccagtggtcgtcccagccaggttcaggtggcaggtggggtctaagggacaagtagtttcaccttcncaaccatcagcagccctgctagtctagaagttntttgactagtttattattggtactagctaagtatgtagttcgaaggttcgcccttaccgtactcccgtaaccggttccgggaccgtaacgggggacctaaccggtacttaacgggaaacttaaaacgtaaaccgtagttcggtacgggacttggaacccaacgtaac

SEQ ID NO: 359885 - DNA, 661 bp, Homo sapiens
  misc_feature: GZ8MTXP01BA38Z.38.1.A01.1.454.CMB.2.raw
  modified_base (197)..(197): a, c, t, g, unknown or other
  misc_feature (197)..(197): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggcctcccagaaatcactggagaaatcgtgatgacgcagtctccagcccaccctgtctgtgtctccgagggganagacgcccaccctctcctgcgacgggccagtcagtagtagttaacgtaaacaaccgtagccttaggtaaccataccgaacgtaaacccgtggacccaggcctaccccgagtacctcctacatctatgatcgcactcccgaaccgacgggcctacgtggtcctacccgagccgtaggttcacggtcggcgtagggtcgggtcgtaaggggactaaggtacgtttccaccttcctacactataccgacgcacgtcctgactagtcgtagtaattgttttgacttagtttattacgtgggtacagtctagtagtagagtacgagtccggtccctacggtacttccccggtaaccggttccgggaccgggtaacggggaccgtaaacggtaacccgttaagggaaaaccttaaaacgggttaaacccggtacgttgggtaccggcttaccggaaccgttaacccgttg

SEQ ID NO: 359886 - DNA, 527 bp, Homo sapiens
  misc_feature: GZ8MTXP01AE18X.38.1.A01.1.454.CMB.2.raw
  modified_base (195)..(195): a, c, t, g, unknown or other
  misc_feature (195)..(195): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (514)..(514): a, c, t, g, unknown or other
  misc_feature (514)..(514): n is a, c, g, or t
  modified_base (523)..(523): a, c, t, g, unknown or other
  misc_feature (523)..(523): n is a, c, g, or t
tcagtcgatcacgtcacgaccggtgctcgatttagacgtctcatcggggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgtagtaacaacctagcctggtaccatcagaaacctggccaggctcccagactctcatctatgatgcatcccacgagggccagtggtcgtcccagccaggttcaagtcggcaggtggtctgggaacaggnttcactcncacatcagcagcctgctagtctagtaagtacttttgacttagtttattagttagtcgtagtctagtactgattcgaggttcggcctcgactccgccgtcggccgaggggacacgtacgtaggaacttaagttaacgaacttggcggtcngactaacgnttcg

SEQ ID NO: 359887 - DNA, 780 bp, Homo sapiens
  misc_feature: GZ8MTXP01A7D4R.38.1.A01.1.454.CMB.2.raw
  modified_base (193)..(193): a, c, t, g, unknown or other
  misc_feature (193)..(193): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggaagaaatcgtgatgacgcagtctccagccacctgtctgtgtctccgagggganagacgcccacctctcctgcgagggccagtcagtagtgttaagtaacaacctagcctaggtaccatacaacgaaacctggacccaggcctacccagtacctcctacagtctaatgaatcgacctactccccgaaccgtaggggccctaacgttcgggtacctacccccgagtcccgtaagggtttccaaggggttccggaccgtaaggggttcggggtacgtacgggggaaacctaaggtaacgtttcccaacgttccctaccaacccgtaatcgaacggtcctaacggccccttgggaccctaacggttacgtttaacggggtaaagtttaacgtttttcggactttaaaggtttttaactttaagttttccggaccggtaaggtacttaaaggttattaggactttaacccggtaggttacccggtaccctaccggtaccttacccggtaaccggttaaccggggaaccggttaaacggggtaaccaaccgggtaaacgtaaacgggttaaaaccttaaaaacggttaaaaccggtaaggttcgggtaaccgtaccgttacggaaccctaaccgttaacgtttccg

SEQ ID NO: 359888 - DNA, 540 bp, Homo sapiens
  misc_feature: GZ8MTXP01EOAA2.38.1.A01.1.454.CMB.2.raw
  modified_base (193)..(193): a, c, t, g, unknown or other
  misc_feature (193)..(193): n is a, c, g, or t
  modified_base (392)..(392): a, c, t, g, unknown or other
  misc_feature (392)..(392): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagaacaactagcctggtaccatcagaacctggccagctccagactcctcatctatgatgcatccacgagggccagtggtctcccagccaggttcagtcggcaggtgggtctggggaacaggtgttcaactctcaccatcagcagcctgcagtctagtaagtnttttgcttagtttattagttgtcgagtctaagttatgatcgagtcgggacctccggtattccgaacccgttcgggaccgagggggaccaacggacgttagggaacttaagttaaacgaacgttgcggctaggcctaaccgttgttccg

SEQ ID NO: 359889 - DNA, 512 bp, Homo sapiens
  misc_feature: GZ8MTXP01A50Z3.38.1.A01.1.454.CMB.2.raw
  modified_base (193)..(193): a, c, t, g, unknown or other
  misc_feature (193)..(193): n is a, c, g, or t
  modified_base (311)..(311): a, c, t, g, unknown or other
  misc_feature (311)..(311): n is a, c, g, or t
  modified_base (389)..(389): a, c, t, g, unknown or other
  misc_feature (389)..(389): n is a, c, g, or t
  modified_base (414)..(414): a, c, t, g, unknown or other
  misc_feature (414)..(414): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagtaacactagcctggtaccatcagaacctggccaggctccagactctcatctatgatgcatcccacgagggccagtggtcncccagccaggttcaggtcggcaggtgggtctggggaacagtgttcactctcaccatcagcagcctgcagtctagagtntttgcttagtttattattgtcagtntagtatgatcagtcggcctcgatccgtaccgttcggccgaggggaccacggtacgtaggacaagttaaacgaagttggcgtctgacctaacttaagtc

SEQ ID NO: 359890 - DNA, 548 bp, Homo sapiens
  misc_feature: GZ8MTXP01C3K9L.38.1.A01.1.454.CMB.2.raw
  modified_base (280)..(280): a, c, t, g, unknown or other
  misc_feature (280)..(280): n is a, c, g, or t
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
  modified_base (399)..(399): a, c, t, g, unknown or other
  misc_feature (399)..(399): n is a, c, g, or t
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggggagagacgcccaccctctcctgcagggccagtcagagtgtagaacactgcctggacatcagaacctggccaggctcccagactcctnatctatgatgcactccacgagggcctacgtggtctcccagccaggttcaggtggctaggtgggtctaggggacnggtagtttccactctcactntcagcagcctgcagtctagtaagtntttgacttagtttattattggtactagctagtntgatanagtcgtcctccgtatcctaaccgttcggaccgtacggggacaaccggtacgttacggaaaccaaacgtaaacgtaacgttcggtacgggaccttcgaaccgaaccgtaag

SEQ ID NO: 359891 - DNA, 571 bp, Homo sapiens
  misc_feature: GZ8MTXP01ES5K8.38.1.A01.1.454.CMB.2.raw
  modified_base (392)..(392): a, c, t, g, unknown or other
  misc_feature (392)..(392): n is a, c, g, or t
  modified_base (427)..(427): a, c, t, g, unknown or other
  misc_feature (427)..(427): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccacctgtctgtgtctccgaggggagagacgcccaccctctcctgcagggccagtcagtagtgttagaacaactgcctggtaccatcaagaacctggacccaggcctacccagacctcctacatctatgatcgcactcccacgacgggcctacgtggtctcccagccaggttcaggtcgcgtaggtgggtctggggaacaggtaacgttccactcctacgaacctntcgacgcacgtcctagactagtctaggaaagtttnttgacttagtttattagttgacgtagtatagtatgatcgtacggtcgtcctcgtacgtccggtacccgggtcggggaccgggactacgacgtaacggaaacttaaacgttaacgttacgtggtcgctcgaccactcgttcgtcg

SEQ ID NO: 359892 - DNA, 535 bp, Homo sapiens
  misc_feature: GZ8MTXP01BYXHG.38.1.A01.1.454.CMB.2.raw
  modified_base (193)..(193): a, c, t, g, unknown or other
  misc_feature (193)..(193): n is a, c, g, or t
  modified_base (282)..(282): a, c, t, g, unknown or other
  misc_feature (282)..(282): n is a, c, g, or t
  modified_base (315)..(315): a, c, t, g, unknown or other
  misc_feature (315)..(315): n is a, c, g, or t
  modified_base (531)..(531): a, c, t, g, unknown or other
  misc_feature (531)..(531): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcgagggccagtcagagtgtagtaacaactgcctggtaccatcagaacctggccaggcctccagacctccnatctatgatgcatcccacgagggccagtggtcnccagcctaggttcaggtcgcaggtgggtctgggaacagtcgttcactctcacctatcagcagcctgctagtctagtaagttatttgacttagtttattagttgtacgtagtctagtatgactcgagtcggccctcgactccgaccgttcgggccgaggggtccacgtacgaggaaacttaagttaaaacgtcgtggtcggctcgacctaaccgttnttcg

SEQ ID NO: 359893 - DNA, 614 bp, Homo sapiens
  misc_feature: GZ8MTXP01A94SB.38.1.A01.1.454.CMB.2.raw
  modified_base (195)..(195): a, c, t, g, unknown or other
  misc_feature (195)..(195): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcagggccagtcagagtgttagaacactagcctggtaccatcagaacctggccaggcctccagacctcctcatctatgatgcactcccacgacgggccacgtggtcgtccccagccgtaggttcaggtggcgtagggttcggggtcgtaagggggacaaggtacgtttccactcctacacctatcacgcaggcctgctagttctagtaagttattttgacttaagttttatttagttcggtactaggtctaggttatgtagttcgaacggtcgtcccttaccgtacttaccccgtaacccgttccggggaccggtaacgggggaccctaaacgggtaccgttaacggaaaccgttaaaacgtaaaccgtacgtggtacggcttacgaaccgttaacgtaacg

SEQ ID NO: 359894 - DNA, 513 bp, Homo sapiens
  misc_feature: GZ8MTXP01ADKGJ.38.1.A01.1.454.CMB.2.raw
  modified_base (196)..(196): a, c, t, g, unknown or other
  misc_feature (196)..(196): n is a, c, g, or t
  modified_base (357)..(357): a, c, t, g, unknown or other
  misc_feature (357)..(357): n is a, c, g, or t
  modified_base (513)..(513): a, c, t, g, unknown or other
  misc_feature (513)..(513): n is a, c, g, or t
tcagtcgatcacgtcacgaccggtgctcgatttagacgtctcatcagggggaggaactgctcagttaggacccagacggaaccatggaagccccagcgcagcttctccttcctcctgatactctggctcccagaaatcactggagaaatcgtgatgacgcagtctccagccaccctgtctgtgtctccgagggganagagcccaccctctcctgcagggccagtcagagtgtagtaacactagcctggtaccatcagaaacctggcaaggctcccagactcctcatctatgatgcatcccaccagggccactggtcgtcccagccaggttcaggtggcaggtggggtctaggggacnggacgttccactctcaccatcagcagcctgcagtctagaagtatttgcttagtttattatggtcagtcagtatgatcgagtcggtcctcgatccaaccgttcggccgagggggacacggacttggaacaagtaaacgactggtgcttagcaacctn

SEQ ID NO: 359895 - DNA, 509 bp, Homo sapiens
  misc_feature: GZ8MTXP01EB7C1.38.1.A01.1.454.CMB.2.raw
  modified_base (193)..(193): a, c, t, g, unknown or other
  misc_feature (193)..(193): n is a, c, g, or t
  modified_base (367)..(367): a, c, t, g, unknown or other
  misc_feature (367)..(367): n is a, c, g, or t
  modified_base (418)..(418): a, c, t, g, unknown or other
  misc_feature (418)..(418): n is a, c, g, or t
  modified_base (493)..(493): a, c, t, g, unknown or other
  misc_feature (493)..(493): n is a, c, g, or t
  modified_base (506)..(506): a, c, t, g, unknown or other
  misc_feature (506)..(506): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagtaacaactgcctggtaccatcaagaacctggccaggctccagactctcatctatgatgcatccacagggccagtggtcgtcccagccaggttcagtcggcaggtgggtctgggaacagtgttcatcacaccatcancagcctgctagtactagaagttatttgacttaagtttattattgtacagtnagttatgatcaggtcgctcgatcacgtcgcgagggaccagactaggaaacaaacgttaaacgaagtcgtggtccngacctaaccgttntcg

SEQ ID NO: 359896 - DNA, 553 bp, Homo sapiens
  misc_feature: GZ8MTXP01AL0SD.38.1.A01.1.454.CMB.2.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (386)..(386): a, c, t, g, unknown or other
  misc_feature (386)..(386): n is a, c, g, or t
  modified_base (419)..(419): a, c, t, g, unknown or other
  misc_feature (419)..(419): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
  modified_base (462)..(462): a, c, t, g, unknown or other
  misc_feature (462)..(462): n is a, c, g, or t
  modified_base (531)..(531): a, c, t, g, unknown or other
  misc_feature (531)..(531): n is a, c, g, or t
  modified_base (553)..(553): a, c, t, g, unknown or other
  misc_feature (553)..(553): n is a, c, g, or t
tcagtcgatcacgtcacgaccggtgctcgatttagacgtctcatcagggggaggaactgctcagttaggacccagacggaaccatggaagtcccagcgcagcttctcttcctcctgatactctggcctcccagaaatcactggagaaatcgtgatgacgcagtctccagccaccctgtctgtgtctccgagggganagacgcccaccctctcctgcagggccagtcagagtgtagaacaactgcctggtaccatcaagaacctggccaggcctcccagacctcncatctatgatcgcactcccacgcggccagtcggtcacccagtccgtaggttcaggtggctagggtcgggtcgtagggactaaggtcgttcacttctacaacntacagcacgtcctgacctaggtcagtaagtttntttcgattagtttattgtggtactagtntagttntagtntcgngtccgtcctacgtactccgtaaccggtcggacggacggacctaggtacgttagaacttaaacgtaacgngtggacgtcacgtaacaacgtn

SEQ ID NO: 359897 - DNA, 604 bp, Homo sapiens
  misc_feature: GZ8MTXP01B1LBU.38.1.A01.1.454.CMB.2.raw
  modified_base (196)..(196): a, c, t, g, unknown or other
  misc_feature (196)..(196): n is a, c, g, or t
  modified_base (392)..(392): a, c, t, g, unknown or other
  misc_feature (392)..(392): n is a, c, g, or t
  modified_base (412)..(412): a, c, t, g, unknown or other
  misc_feature (412)..(412): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgcccaccctctcctgcagggccagtcagagtgttagaacaacctagcctggtaccatcagaaactggccagctcccagactcctcatctatgatgcactcccgacgagggccacgtggtctcccagcccgtaggttccaggtggcaggtcgggtctaggggaactggtacgttcacctcacaccatcagcancctgctaagtctaggaaatnttttagacttaagtttattatttggggtactaggtctaaggttatggtaactcaacggggttcgaccccttacggacttcccgtaacccgtttcggggacccgtaacgggggacctaacggacgttaacggggaaccttaaaaggttaaaccggaccgtttcgggtcggtaccttacgtaacccttaacgtg

SEQ ID NO: 359898 - DNA, 637 bp, Homo sapiens
  misc_feature: GZ8MTXP01BHN83.38.1.A01.1.454.CMB.2.raw
  modified_base (473)..(473): a, c, t, g, unknown or other
  misc_feature (473)..(473): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccacctgtctgtgtctccgaggggagagacgccaccctctcctgcagggccagtcaggtagtagttaagtaaacaaactgcctaggtaaccatacaagaaacctggaccaggcctcccagtacctcctacatctatgatgaccactcccaccgacgggccctacgtcggtcgtaccccaggcccgtaggttccaggttcggacgtaggggtcggggtacgtaacggggaactgggtacgtttcccaaccttcctaccgaaccctatccgacgccgacgcccgtgactagttacgtagtaaagttnttttgactttaagtttattagttggtactagtactaggtatgatcgtaggtcgtccctacgtacctcccgtaaccggttcgggaccgtaggggacctacggtaacgttaacgggaacttaaaacgtaaaccggagtcggtacggacttacggcccttaaccgtg

SEQ ID NO: 359899 - DNA, 543 bp, Homo sapiens
  misc_feature: GZ8MTXP01E0UES.38.1.A01.1.454.CMB.2.raw
  modified_base (193)..(193): a, c, t, g, unknown or other
  misc_feature (193)..(193): n is a, c, g, or t
  modified_base (286)..(286): a, c, t, g, unknown or other
  misc_feature (286)..(286): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagtaacaacctagcctggtaccatcagaaacctggccaggcctcccagacctcctnatctatgatgcatcccacagggcccagtggtctccccagccaggttcagtcggcaggtgggtcnggggaacagnttcactctcaccatcagcagcctgcagtctagaagtatttgcttagtttattattgtcagcagtatgatcagtcggcctccgatccgaccgttcgggccgttagggggacaccggacgtacgggaacttaaacgttaaaaccgtaacctggttaacgggctcgacctaaccgttaagttcccg

SEQ ID NO: 359900 - DNA, 636 bp, Homo sapiens
  misc_feature: GZ8MTXP01CYHSY.38.1.A01.1.454.CMB.2.raw
  modified_base (196)..(196): a, c, t, g, unknown or other
  misc_feature (196)..(196): n is a, c, g, or t
  modified_base (277)..(277): a, c, t, g, unknown or other
  misc_feature (277)..(277): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggganagacgcccaccctctcctgcagggccagtcagagtgtagaacactgcctgtaccatcagaacctgccagctccagctcctnatctatgatcgcactcccacgacgggccagttcggcgtcccagcccgtaggttccaggtcggcgtaggtcggggtcctaagggggacctggtacgtttccaccttcgaccaaccgtatccagcacgcctgctagtctagaagttcttttgacttaagttttacttagtttcgtacgtaagtctaagttagtgtacttcgtaacgggttccggtaccccttacgaccgttcccgtaaccccgggtttcgggaaccccgggtaacgggggaaccctaaaccggggtacgttaacggggaaaccttaaaacggttaaaccggtaaccgtggggtacggcttacggaacccgttaaccgttcg

SEQ ID NO: 359901 - DNA, 641 bp, Homo sapiens
  misc_feature: GZ8MTXP01EJGGR.38.1.A01.1.454.CMB.2.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
  modified_base (365)..(365): a, c, t, g, unknown or other
  misc_feature (365)..(365): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggganagacgcccaccctctcctgccagggccagtcagagtgttagaacacctagcctggtaccatcagaacctgccaggctccagactccnatctatgatgacactcccacgagggcctacgtggtctccccagccgtaggttcaggtggactagggtgggtctaggggacnggtagtttccactctaccaaccatccagcagcctgcagttacgtagtaagttattttgacttaagttttatttagttggggttactaaggtcgtaagttagttaggacttacgtacgggttcggtaccccgttaccggtacttcccgtaaacccggtttccgggacccggaaacggggggttaaacccaaccgggtaacgttacggggaaaccttaaaacggttaaaacccgaaccgttgggtacgggccttacgggtaacccgttaaacccgttg

SEQ ID NO: 359902 - DNA, 643 bp, Homo sapiens
  misc_feature: GZ8MTXP01CP6UJ.38.1.A01.1.454.CMB.2.raw
  modified_base (196)..(196): a, c, t, g, unknown or other
  misc_feature (196)..(196): n is a, c, g, or t
  modified_base (414)..(414): a, c, t, g, unknown or other
  misc_feature (414)..(414): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctccagaaatcactggagaaatcgtgatgacgcagtctccagccaccctgtctgtgtctccgaggggganagacgcccaccctctcctgcagggccagtcagtagtgttagtaacactgcctggtaccatcagaacctggacccaggcctccagacctcctacatctatgatcgctactcccaaccgagggccctacgtggcctcccagcccgtaggttccaggtcggacgtagggttcgggtcgtaaggggacctaaggtacgtttccacttccctacaacccgtanaccgacgcgacgtccgtagacgtagtacgttagtaagtttagtttagtactttaagtttagtttagttcggtacgtagtactaagttagtagtacgttcgtacggtccgtaccctaccgtacgtcccgtaacccggtcgggaccggtacgggaaccgtaacggtaacgttaacggaaacttaaaacgtaaacgacgttcggtacggtacttacgtaaccgttaacgtaa

SEQ ID NO: 359903 - DNA, 550 bp, Homo sapiens
  misc_feature: GZ8MTXP01DCBN5.38.1.A01.1.454.CMB.2.raw
  modified_base (279)..(279): a, c, t, g, unknown or other
  misc_feature (279)..(279): n is a, c, g, or t
  modified_base (286)..(286): a, c, t, g, unknown or other
  misc_feature (286)..(286): n is a, c, g, or t
  modified_base (396)..(396): a, c, t, g, unknown or other
  misc_feature (396)..(396): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagaacaacctagcctggtaccatcagaacctggccaggctcccagactccncatctangatgcatcccaccgagggccagtggtctcccagccaggttcaggtcggcaggtgggtctggggaacagtcgttcactctacaccatcagcagcctgcagtctagtaagtntttgacttagtttattattgtctagtctagtatgaatcgtagtacggcctccgtatccgtaccgttccggaccgttagggggaccaacggacgtacgggaacttaaagttaaaacgtaacgtaggtaacggctacgacctaaccgttaattccg

SEQ ID NO: 359904 - DNA, 527 bp, Homo sapiens
  misc_feature: GZ8MTXP01B4ABB.38.1.A01.1.454.CMB.2.raw
  modified_base (193)..(193): a, c, t, g, unknown or other
  misc_feature (193)..(193): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccacctctcctgcagggccagtcagagtgttagaacactagcctggtaccatcagaacctggccaggcctcccagacctcctcatctatgatgcatccaccagggccacgtggtctcccagcctaggttcagtcgcaggtgggtctggaacagtcgttcactctcaccatcagcagcctgcagtctaggaagtatttgcttagtttattattgtcagtctaagtatgtatcgaggtcggtccctcgtactccgtacgttcggaccgttaggggaccacggaacgtggaacaaacgttaacgaactggtcggctgacctaacgaagttcg

SEQ ID NO: 359905 - DNA, 564 bp, Homo sapiens
  misc_feature: GZ8MTXP01EZDRH.38.1.A01.1.454.CMB.2.raw
  modified_base (251)..(251): a, c, t, g, unknown or other
  misc_feature (251)..(251): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctcctgcagggccagtcagagtgttagaacaactgcctgtacctnagaactgcngcncanctcnatcatgatgccatcccacgacggccagtggtctccccagccctaggttcaggtggacctagggtgggtcgtaggggacctaagtacgttcaccttcacaccgtatcagcagtctgcgagtctagtaaagtattttgacgttaatttattagttgtacgtaggtactagttataggtatcgtagtcggtacctccgtataccctaccgttcggaaccggtaagggacctaacgaccgtaggaaaccaaacgttaaaacgacgtgtggtctacggacttaccgtaacgttcgttcg

SEQ ID NO: 359906 - DNA, 522 bp, Homo sapiens
  misc_feature: GZ8MTXP01B9OWJ.38.1.A01.1.454.CMB.2.raw
  modified_base (193)..(193): a, c, t, g, unknown or other
  misc_feature (193)..(193): n is a, c, g, or t
  modified_base (281)..(281): a, c, t, g, unknown or other
  misc_feature (281)..(281): n is a, c, g, or t
  modified_base (311)..(311): a, c, t, g, unknown or other
  misc_feature (311)..(311): n is a, c, g, or t
  modified_base (348)..(348): a, c, t, g, unknown or other
  misc_feature (348)..(348): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgtagtaacaacctagcctggtaccatcagaacctggccaggcctccagacctcncatctatgatgcatccacaggccatggtcnccagccaggtcaggtcggcaggtgggctgggaacagngttcactctcacatcagcagcctgcagtctagtaagttatttgacttagtttattagttgtcgagtctagttatgatcgaggttccgcctcgactccgtacccgttcggccgttaggggacacggactgggaacttaaagttaacgaactggtcggctagcctaacgttgttcg

SEQ ID NO: 359907 - DNA, 547 bp, Homo sapiens
  misc_feature: GZ8MTXP01A7LG5.38.1.A01.1.454.CMB.2.raw
  modified_base (195)..(195): a, c, t, g, unknown or other
  misc_feature (195)..(195): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (437)..(437): a, c, t, g, unknown or other
  misc_feature (437)..(437): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagaacacctgcctggtaccatcagaacctggccaggctcccagactctcatctatgatgcactcccacagggccacgtggtcgtcccagccaggttcaggtggcaggtgggtcngggacngagttcactctcacatcagcacgctgcagttctaggtaagttattttgacttaagttttatttaattcgggttactagtctagtntagactcgagtcggtcctacgctcgaaccgttcggccgtacggggaccaacggtcgttacggaacttaaacgttaaacgacgtcggtacggcttacggccttaaccgtaa

SEQ ID NO: 359908 - DNA, 578 bp, Homo sapiens
  misc_feature: GZ8MTXP01EWWE2.38.1.A01.1.454.CMB.2.raw
  modified_base (283)..(283): a, c, t, g, unknown or other
  misc_feature (283)..(283): n is a, c, g, or t
  modified_base (371)..(371): a, c, t, g, unknown or other
  misc_feature (371)..(371): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcagggccagtcagagtgttagtaacaactagcctggtaccatcagaacctggccaggctcccagacctcctnatctatgatgcatccacagggccacgtggtctcccagccaggttcaggtcggcaggtgggtctggggaacagtgttcactctcacctntcagcagcctgcagtctagaagttatttgcttagttttattagtttgtacgtagtacgtagttagtagatcgaggttcggtccctccggactccgtaacccgttcgggacccggaacgggggtaccaccgggtacgtaacgggaacgttaaacgttaaaaccggtaacgtggttaacggcgtacggacctaaccgttcgttaacccg

SEQ ID NO: 359909 - DNA, 631 bp, Homo sapiens
  misc_feature: GZ8MTXP01A1WNV.38.1.A01.1.454.CMB.2.raw
  modified_base (286)..(286): a, c, t, g, unknown or other
  misc_feature (286)..(286): n is a, c, g, or t
  modified_base (420)..(420): a, c, t, g, unknown or other
  misc_feature (420)..(420): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagcccaccctgtctgtgtctccgaggggagagacgcccaccctctcctgcagggccagtcagagtgttaagtaacactgcctggtaccatcagaacctggccaggcctccagacctccnatctatgatgcactcccaccgagggcctacgtggtctcccagtcctaggttcaggtcggcgtagggtgggtctaaggggacctggtacgttccactcgtacaccatccagcacgcctgctagtctagtaagttnttttacgactttaagtttatttacgttggtactaggtactagttatggtaacttcgtaacgggtccgtccccgttaccgtaacgttcccggtaacccggttccggggaccggtaaacgggggaccaaaccgggtaacgttacgggttaaaccttaaaacggttaaaccggacgtttcgggaacggtccgacggtaacccttaacgttaacg

SEQ ID NO: 359910 - DNA, 561 bp, Homo sapiens
  misc_feature: GZ8MTXP01BVJ4V.38.1.A01.1.454.CMB.2.raw
  modified_base (196)..(196): a, c, t, g, unknown or other
  misc_feature (196)..(196): n is a, c, g, or t
  modified_base (453)..(453): a, c, t, g, unknown or other
  misc_feature (453)..(453): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgtagtctccagccaccctgtctgtgtctccgagggganagagcccacctctcctgcagggccagtcagagtgttagaacactagcctggtaccatcaagaacctggccaggcctcccagacctcctcatctatgatcgacactcccaccgagggcctacgtgggtctccccagcctagggttcaggtcggctagggtgggtctggggaaacaggtcgttccactcctaccacctatcgagcacgcctgctagtacgtagtaagttatttgacttagtttattagttgtacgagtntagtatagtatcgagtcgtcctcgactccgaccgtcggcgaggggacacggacgtggaaacttaacgttaaacggaacgtggtcgcgtacgacctaacgttaagttcc

SEQ ID NO: 359911 - DNA, 559 bp, Homo sapiens
  misc_feature: GZ8MTXP01A6LYW.38.1.A01.1.454.CMB.2.raw
  modified_base (191)..(191): a, c, t, g, unknown or other
  misc_feature (191)..(191): n is a, c, g, or t
  modified_base (283)..(283): a, c, t, g, unknown or other
  misc_feature (283)..(283): n is a, c, g, or t
  modified_base (412)..(412): a, c, t, g, unknown or other
  misc_feature (412)..(412): n is a, c, g, or t
tcagtcgatcacgtcacgaccggtgctcgatttagacgtctcatcatgggggaactgctcagttaggacccagacggaaccatggaagccccagcgcagcttctcttcctcctgatactctggctccagaaatcactggagaaatcgtgatgacgcagtctccagccacctgtctgtgtctccgagggganagacgccaccctctcctgcagggccagtcagagtgttaagtaacaacctagcctaggtaccatcagaacctggccaggctcccagactcctnatctatgatgcactcccacgagggccacgtggtcgtccccagcctaggttccaggtcggacaggtcgggtctaggggacaaggtctttcacttcacaaccatccagcagcctgactagtctagaagttntttgcttaagtttattattcggtctagtctagtatgtatcgtagtcggtcctcgtatccgtaaccgttcggccgaaggggaccaacggtacttagggaacaaaacgttaaaccggagttggtacggcttacggtaacaaccgttaag

SEQ ID NO: 359912 - DNA, 554 bp, Homo sapiens
  misc_feature: GZ8MTXP01AEZLL.38.1.A01.1.454.CMB.2.raw
  modified_base (440)..(440): a, c, t, g, unknown or other
  misc_feature (440)..(440): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccacccctctcctgcagggccagtcagagtgttagaacacctagcctggtaccatcaagaaacctggccaggctcccagacctctcatctatgatgcatcccacagggcccagtggtcgtccccagcccgtaggttcaggtcggcgtaggtcggggtctggggaacaggtcgttccacctctccacatcgagccagtcctgcagttctaggattagttttgacttagtttattagttcgtanaagctagttagtgattcgaggtcgtcctcgacttccaccggttcggccgacggggacacggacgtaggaaacttaacgaaaccgaagttcggcgactcgacctaaccgttgtcg

SEQ ID NO: 359913 - DNA, 578 bp, Homo sapiens
  misc_feature: GZ8MTXP01DTY82.38.1.A01.1.454.CMB.2.raw
  modified_base (285)..(285): a, c, t, g, unknown or other
  misc_feature (285)..(285): n is a, c, g, or t
  modified_base (368)..(368): a, c, t, g, unknown or other
  misc_feature (368)..(368): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggggagagacgcccaccctctcctgcagggccagtcagagtgttagaacaactgcctggtaccatcaagaacctggccaggctcccagactccnatctatgatgcatcccaccgagggccctacgtggtctccccagcccaggttccaggtggctagggtggggtctagggggaacngggtactttccaacttcctacaacctatccagcacgcctgcctaaggttctagtaagttagttttgacttagtttattagttgggtactagtctaagtatgtattcgtaggtcggtccctacgtctcctaacccgttcgggccggaacggggaccaacggtacgttacgggaacaaacgtaacgaacgtgtggcttgaaccgaacgtaac

SEQ ID NO: 359914 - DNA, 560 bp, Homo sapiens
  misc_feature: GZ8MTXP01BP1VT.38.1.A01.1.454.CMB.2.raw
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcagggccagtcagagtgttagaacactagcctggtaccatcagaacctggccaggctccagactctcatctatgatgcatcccacgagggccacgtgggtctcccagcctaggttcaggtcggcaggtcgggtctggggaacagtcgttcactctacacctatcagcagcctgcagtctagtagtattttgacttagtttattattgtacagtctagtagtagtaactcgtagttcggcccttccggacttccgtacccgttcgggaccgttaagggggaccacggtacgtacggaaacttaaacgttaaaacggaactagggtcgcgtagacctaaccttaagttccg

SEQ ID NO: 359915 - DNA, 594 bp, Homo sapiens
  misc_feature: GZ8MTXP01EGYJO.38.1.A01.1.454.CMB.2.raw
  modified_base (195)..(195): a, c, t, g, unknown or other
  misc_feature (195)..(195): n is a, c, g, or t
  modified_base (288)..(288): a, c, t, g, unknown or other
  misc_feature (288)..(288): n is a, c, g, or t
  modified_base (364)..(364): a, c, t, g, unknown or other
  misc_feature (364)..(364): n is a, c, g, or t
  modified_base (409)..(409): a, c, t, g, unknown or other
  misc_feature (409)..(409): n is a, c, g, or t
tcagtcgatcacgtcacgaccggtgctcgatttagacgtctcatcatgggggaactgctcagttaggacccagacggaaccatggaagccccagcgcagcttctcttcctcctgatactctggctcccagaaatcactggagaaatcgtgatgacgcagtctccagcccaccctgtctgtgtctccgaggggganagacgcccaccctctcctgcagggccagtcagagtgttagaacaacctagcctggtaccatcagaaacctggccaggcctcccagacctcctnatctatgatgcactcccacgagggccacgtggtctccccagccgtaggttcaggtggctaggtgggtctagggacnggtattcactcacacatcagcagcctagctagtctagtaaagttntttagacttagtttattagttgtacgagtacgtaagtatagtactcgtacggtccgtacccttaccgtaccttcccggtaacccggttcgggaccgggtaacggggaacctaaccggtaacgttaacggaaacttaaaacgtaaaccggtacgttgggtacgacgttacgtaaccgttaacgtcg

SEQ ID NO: 359916 - DNA, 536 bp, Homo sapiens
  misc_feature: GZ8MTXP01AQEQ7.38.1.A01.1.454.CMB.2.raw
  modified_base (531)..(531): a, c, t, g, unknown or other
  misc_feature (531)..(531): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagaacactagcctggtaccatcagaaacctggccaggcctcccagacctcctcatctatgatgcatcccaccgagggcccacgtgggtctccccagcccaggttcaggtcggctaggtgggtctggggaacaggtgttcactctcaccatcagcagcctgcagtctagaagttattttgcttagtttattagttgacagtctagtatgatcgagtcgcctcgtatccgaccgttcgggccgttaggggaccttacggacgtaggaaaccaagttaaacgaacgtggtcggctgacctaacgngttcg

SEQ ID NO: 359917 - DNA, 602 bp, Homo sapiens
  misc_feature: GZ8MTXP01DQU9A.38.1.A01.1.454.CMB.2.raw
  modified_base (194)..(194): a, c, t, g, unknown or other
  misc_feature (194)..(194): n is a, c, g, or t
  modified_base (288)..(288): a, c, t, g, unknown or other
  misc_feature (288)..(288): n is a, c, g, or t
  modified_base (323)..(323): a, c, t, g, unknown or other
  misc_feature (323)..(323): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (404)..(404): a, c, t, g, unknown or other
  misc_feature (404)..(404): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggganagacgcccaccctctcctgcagggccagtcagagtgttaagaacaactagcctggtaccatcaagaaacctggccaggcctcccagacctcctnatctatgatgcatcccaccgagggcccagtggtcncccagcctaggtcagtcggcaggtgggtctgggaacagcgttcacttcncaaccatcancacgctgcagtctagtaagttntttgacttagtttattagttgtacagtactagttatgtactcgtaggtcggtccctcgtacttcccgtaacccgttccggggaacccgaacggggggaaccttaaccgggaaccgttaacgggaaacccgttaaaagttaaaaacccggtaagttacgggtaacgggtactccggaacctaaccgttaacgtttcccg

SEQ ID NO: 359918 - DNA, 541 bp, Homo sapiens
  misc_feature: GZ8MTXP01ESBWS.38.1.A01.1.454.CMB.2.raw
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcagggccagtcagagtgttagtaacaactagcctggtaccatcagaacctggccaggctcccagactcctcatctatgatgcatcccaccgagggccacgtggtcgtcccagcctaggtcaggtcggctaggtgggtctggggaacaggtcgttcactcctacaccatcagcagcctgcagtctagaattatttgacttagtttattagttgtacgtagtctagtatgatcgtagtcggcctccgtatccgtaccgtcggccgaggggacacggacgtaggaaccttaaagttaaacgaactggtggctggacctaaccgttaagttccg

SEQ ID NO: 359919 - DNA, 768 bp, Homo sapiens
  misc_feature: GZ8MTXP01DJURI.38.1.A01.1.454.CMB.2.raw
  modified_base (193)..(193): a, c, t, g, unknown or other
  misc_feature (193)..(193): n is a, c, g, or t
tcagtcgatcacgtcacgaccggtgctcgatttagacgtctcatcagggggggaactgctcagttaggacccagacggaaccatggaagccccagcgcagcttctcttcctcctgatactctggctcccagaaatcactggagaaatcgtgatgacgcagtctccagccacctgtctgtgtctccgagggganagacgcccaccctctcctgcagggccagtcagagtgttagaacactgcctaggtaccatacagaacctggaccaggcctacccagtacctcctacacttctaatgatcgaccactccccgaaaccgtacgggggcccctaacggtttcgggtccgtacccccgaggtaccccgtaagggtttcccgaaggttccgggaccgtagggggttcggggtaccgtagggggaaaccctaagggttcgtttacccaacccgtttccctacccaaacccgtagtaccgaaacggtaccgaaccggtcccgttacggaccgtaacggttaccgttaacggttaaacggtttaacgtttttacggttaacgtttaacgttttaaacttttaagtttaccggttacggtaagttaacgttaaggttaacgttagtacgttacgtacggttccggtacccgtacccgtacgttacccgtacccggttaacccgggtaggaccccccccgggagaaccgtaacgtacggaacgttaaacgttaaacgtaacgtagtcggtcgtacgacctaaccgttaacgttccg

SEQ ID NO: 359920 - DNA, 588 bp, Homo sapiens
  misc_feature: GZ8MTXP01A910M.38.1.A01.1.454.CMB.2.raw
  modified_base (195)..(195): a, c, t, g, unknown or other
  misc_feature (195)..(195): n is a, c, g, or t
  modified_base (287)..(287): a, c, t, g, unknown or other
  misc_feature (287)..(287): n is a, c, g, or t
  modified_base (364)..(364): a, c, t, g, unknown or other
  misc_feature (364)..(364): n is a, c, g, or t
  modified_base (384)..(384): a, c, t, g, unknown or other
  misc_feature (384)..(384): n is a, c, g, or t
  modified_base (417)..(417): a, c, t, g, unknown or other
  misc_feature (417)..(417): n is a, c, g, or t
  modified_base (588)..(588): a, c, t, g, unknown or other
  misc_feature (588)..(588): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttaagtaacaacctagcctggtaccatcagaacctggccaggcctcccagactcctnatctatgatgcactcccacgacgggccacgtggtcgtccccagccaggttcagtggctaggtcgggtcgtagggacnggtacttcactctaccacgntacagcacgtcctgcctagttctagtaagtttnttgagtttagtttattagtggtacgtagtagtagtatgtacgttcggtacggtccgtacccttacggtacctccggtaacccggtcggggaccggtaacggggaccaacggtacgttaacggaaaccttaaaggttaacgaggttcggacgcttacgtaaccttaaccgtn

SEQ ID NO: 359921 - DNA, 566 bp, Homo sapiens
  misc_feature: GZ8MTXP01AFTN3.38.1.A01.1.454.CMB.2.raw
  modified_base (193)..(193): a, c, t, g, unknown or other
  misc_feature (193)..(193): n is a, c, g, or t
  modified_base (421)..(421): a, c, t, g, unknown or other
  misc_feature (421)..(421): n is a, c, g, or t
  modified_base (562)..(562): a, c, t, g, unknown or other
  misc_feature (562)..(562): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcagggccagtcagagtgttagaacaacctgcctggtaccatcagaaacctggccaggcctcccagacctcctcatctatgatgcactcccaccgagggccctacgtgggtctcccagccctaggttcaggtcggcagggttcggggtctggggaaacagggtcgtttccaccgtctaccaccatccagcacgcctgcaggtctagtaatnttttagcttagtttattattcgtacagtacgtagtatgtatcgagttcgccttcgactccgtccgtcggccggttacggggacaacggtacgtaacgggaacttaaagttaaacgaacgtgtcgactcgacctaaccgttntccg

SEQ ID NO: 359922 - DNA, 583 bp, Homo sapiens
  misc_feature: GZ8MTXP01D39IE.38.1.A01.1.454.CMB.2.raw
  modified_base (287)..(287): a, c, t, g, unknown or other
  misc_feature (287)..(287): n is a, c, g, or t
  modified_base (442)..(442): a, c, t, g, unknown or other
  misc_feature (442)..(442): n is a, c, g, or t
  modified_base (456)..(456): a, c, t, g, unknown or other
  misc_feature (456)..(456): n is a, c, g, or t
  modified_base (467)..(467): a, c, t, g, unknown or other
  misc_feature (467)..(467): n is a, c, g, or t
  modified_base (578)..(578): a, c, t, g, unknown or other
  misc_feature (578)..(578): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggggagagacgcccaccctctcctgcagggccagtcagagtgttagtaacaactagcctaggtaccatcaagaacctggccaggcctccagacctcctnatctatgatgcactcccaccgagggcctacgtcggtcgtccccagccctaaggttcaggtcggaccgtagggtcgggggtctacggggaaacctaggtaacgttcctaaccttccctaccaccctatcaagcagcctgactagtctaggtaattntttgcttaagtttnttagttcgtanaagtctagttatgatcgaggtcgcctacgtatccgtaaccgtcggacgagggacccaagtacgtaacggaacttaaacgttaaaccgaacgtgtcggctcgaccctaacgnttccg

SEQ ID NO: 359923 - DNA, 586 bp, Homo sapiens
  misc_feature: GZ8MTXP01C69TL.38.1.A01.1.454.CMB.2.raw
  modified_base (209)..(209): a, c, t, g, unknown or other
  misc_feature (209)..(209): n is a, c, g, or t
  modified_base (353)..(353): a, c, t, g, unknown or other
  misc_feature (353)..(353): n is a, c, g, or t
  modified_base (403)..(403): a, c, t, g, unknown or other
  misc_feature (403)..(403): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaatcactggagaaatcgtgatgacgcagtctccagccaccctgtctgtgtctccgaggggagagagcccaccctctccngcgagggccagtcagagtgttagaacaacctagcctggtaccatcagaaacctggccaggcctcccagacctcctcatctatgatgcatcccaccgagggccacgtggtcgcccagcctaggttcaggtcggctaggtgggtcnggggaacagtcgttcactctacacatcagcagcctgcagtctagtaagtnttttgcttagtttatttagttgtacgagtacgtaagttagtgaatcgaggttccgcctccgtactcccgtacccgttaacgggaccgttacgggggaccttacggaaccgtacgggaaaacttaaacgttaaaacggtaaccgttagggtcgggtcttacggacctaacccgttaatttcccg

SEQ ID NO: 359924 - DNA, 568 bp, Homo sapiens
  misc_feature: GZ8MTXP01B1VPD.38.1.A01.1.454.CMB.2.raw
  modified_base (195)..(195): a, c, t, g, unknown or other
  misc_feature (195)..(195): n is a, c, g, or t
  modified_base (264)..(264): a, c, t, g, unknown or other
  misc_feature (264)..(264): n is a, c, g, or t
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
  modified_base (568)..(568): a, c, t, g, unknown or other
  misc_feature (568)..(568): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccacctctcctgcagggccagtcagtagtgttaagaacaactgcctaggtaccatcagaaccnggcaggctccagactcctnatctatgatcgactactcccaacgngggcctacgtggtctcccagccgtaggttcagtggctagggtcgggtctagggactggtgttccacttccaccacatcagcacgctgctagtcgtagtaagttatttgacgttagttttaattacgttggggtactaggtactaagtttatggtaacttcgaacgttcgggtccctacgtactcccgtaacgttcgggacggtacgggacacggtacttagggaacttaaagtaacgactggacgcttacggccaacgtn

SEQ ID NO: 359925 - DNA, 691 bp, Homo sapiens
  misc_feature: GZ8MTXP01DDZTC.38.1.A01.1.454.CMB.2.raw
  modified_base (197)..(197): a, c, t, g, unknown or other
  misc_feature (197)..(197): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctccagaaatcactggaagaaatcgtgatgacgcagtctccagccaccctgtctgtgtctccgaggggganagacgcccaccctctcctgcgagggccagtcagagtgttaagaacactagcctagtaccatcaagaaacctggaccaggcctacccagtacctcctacatctangatnacactacccacgacgggccctacgttcgggtcctaccccaggcccgtaggttccgaacggttcggggacgtaggggtcggggtcggtaagggggaactaaggtacgttcccactttccaccaacctatacccgaacgcaacgtcccgtagaccgttaaggttaccgtaaggtaaacgtttagtttttcgatttaagtttttaattagtttacgggtactaaggtctaaggtatagtactcgtaagggttccgacccttacgtaacgttcccgtaacccggttaccgggaccggtaaacgggggacctaaacgggtaacgttaacgggaaacttaaaacggttaaaccgggagttcgggtacggacttccggtaaccaacgttaacg

SEQ ID NO: 359926 - DNA, 725 bp, Homo sapiens
  misc_feature: GZ8MTXP01DVJQ3.38.1.A01.1.454.CMB.2.raw
  modified_base (197)..(197): a, c, t, g, unknown or other
  misc_feature (197)..(197): n is a, c, g, or t
  modified_base (725)..(725): a, c, t, g, unknown or other
  misc_feature (725)..(725): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtcctccgagggganagacgccaccctctcctgcagggccagtcagagttgttaagtaacaactagcctaggtaccatcaagaaccgtggaccaggcctacccagaccttcctacatctatgatcgacactacccgacgacgggaccctacggtcggtccgtaccccaggacccgtaggttccaggtcggacgtaggggtcgggtcgtaacggggaactaagggtacgtttacccacccgttcctaacccaacccgtataccgaacgccgaacggtcccttaggacctaaggttaccgtaaggttaaagtttacgtttttaggactttaaaggtttttaactttacgtttacggtaacgtaaggttaccgttaaaggttacttaggtaacttaccggttaagggttcccggtaccccttacggtaccttacccggtaacccgggttccggggaaccggtaaccgggggaacctaacgggtaacgttaacggaaaacttaaacggtaaaccgtagtcggtacggcttacgaacccttaacgttn

SEQ ID NO: 359927 - DNA, 568 bp, Homo sapiens
  misc_feature: GZ8MTXP01DXQK7.38.1.A01.1.454.CMB.2.raw
  modified_base (195)..(195): a, c, t, g, unknown or other
  misc_feature (195)..(195): n is a, c, g, or t
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (363)..(363): a, c, t, g, unknown or other
  misc_feature (363)..(363): n is a, c, g, or t
  modified_base (389)..(389): a, c, t, g, unknown or other
  misc_feature (389)..(389): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagaacccacctctcctgcagggccagtcagagtgttagaacaactagctggtaccatcagaactgcagctccanctcnatcatgatgcatccaaccgagggccacgtggtcgcccagccaggttcaggtcgctaggtgggtctggggaacagtgttcactctacaccntcagcagcctgctagtctagtaagtntttgattatttattattcgtagagtgtaagttagtcgtatcgtaggttcggtcccttaccgtactaccgtacccggtccgggaccggaacggggtaaccaacggtaacgtaacggaaaacgttaaaacgttaaaaccgtaacgttcggtaacgtactacgacctaaccgttaacgttcg

SEQ ID NO: 359928 - DNA, 527 bp, Homo sapiens
  misc_feature: GZ8MTXP01D4FJW.38.1.A01.1.454.CMB.2.raw
  modified_base (358)..(358): a, c, t, g, unknown or other
  misc_feature (358)..(358): n is a, c, g, or t
  modified_base (399)..(399): a, c, t, g, unknown or other
  misc_feature (399)..(399): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgccaccctctcctgcagggccagtcagagtgttagtaacaactagcctggtaccatcagaacctggccaggctcccagacctcctcatctatgatgcactcccacagggccacgtggtctcccagcctaggttcaggtggcaggtgggtctaggggacnggagttcactctcaccatcagcagcctgcagtctagaagtntttgactagtttattattgtcagtcagtatgatcgagtcggtcctcgactcaaccgttcggccgtaggggaccacggtacgttaggaacttaaacgtaaacgaacgtggtggcttacgccaaccgtaa

SEQ ID NO: 359929 - DNA, 567 bp, Homo sapiens
  misc_feature: GZ8MTXP01AYKKA.38.1.A01.1.454.CMB.2.raw
  modified_base (194)..(194): a, c, t, g, unknown or other
  misc_feature (194)..(194): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgcccacctctcctgcagggccagtcagagtgttagaacaactgcctggtaccatcaagaacctggaccaggcctacccagacctcctacagtctatgatgcactccacgagggcctacgtggtctcccagccgtaggttcaggtcggctaggtgggtctggggaacaggtgttccacttctacactatcagcagcctgctagtctagtaagttatttgacttagtttattagttgtactagtcgtagtatgtatcgtagtcgtcctcgactccgaccgttcggcgttaggggaccacggtacgtaggaaccttaaagttaaaccggaacgttaggaacgggtctacggacctaaccgttaacgtttccg

SEQ ID NO: 359930 - DNA, 559 bp, Homo sapiens
  misc_feature: GZ8MTXP01CDFCK.38.1.A01.1.454.CMB.2.raw
  modified_base (193)..(193): a, c, t, g, unknown or other
  misc_feature (193)..(193): n is a, c, g, or t
  modified_base (318)..(318): a, c, t, g, unknown or other
  misc_feature (318)..(318): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcagggccagtcagagtgttagtaacacctagcctggtaccatcagaacctggccaggctcccagacctcctcatctatgatgcatcccacgagggcccagtggtcncccagccaggttcagtcgcaggtgggtcngggaacagngttcactctcaccatcagcagcctgctagtctagagttattttgacttagtttattattgtacgtagtcgtattacgtagacttcgaggttcggcccttcgtactcccgaccgttccgggacggacggggaccacggttaaccgtgggaaaccttaacgttaaaccgtaagttggtcggctcgaccctaaccgttaatttccg

SEQ ID NO: 359931 - DNA, 527 bp, Homo sapiens
  misc_feature: GZ8MTXP01A9840.38.1.A01.1.454.CMB.2.raw
  modified_base (193)..(193): a, c, t, g, unknown or other
  misc_feature (193)..(193): n is a, c, g, or t
  modified_base (282)..(282): a, c, t, g, unknown or other
  misc_feature (282)..(282): n is a, c, g, or t
  modified_base (359)..(359): a, c, t, g, unknown or other
  misc_feature (359)..(359): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagaacaactagcctggtaccatcagaacctggccaggcctccagacctcctnatctatgatgcatcccaccgagggccagtggtctccccagcctaggttcaggtcggcaggtgggtctggggaacagngttcactctcaccntcancagcctgacagtcgtagtaagttattttcgattagtttattattgtacagtctagtatgtatgaggtcgcctcgatccgccgttcggcgaggggaccacggacgtaggaacttaaagttaacgaacgtgtcggctgaccaacgttgttcg

SEQ ID NO: 359932 - DNA, 752 bp, Homo sapiens
  misc_feature: GZ8MTXP01D3CR7.38.1.A01.1.454.CMB.2.raw
  modified_base (195)..(195): a, c, t, g, unknown or other
  misc_feature (195)..(195): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccacctgtctgtgtctccgagggganagacgcccaccctctccgtgcgacgggccagtcaagtagttagttaacgtaaaccaaccgtagccgtacggtaacccataccgaacgaaacccgtggacccaacggcctacccagtacctcctcatctatgatcgactacgtacccaaccgacgggtccctacgttcggtccgtaccccgacggccgttaagggttccgaggttcgggacgttagggggttcggggtccgtaacgggggaactaagggttccgtttcccaaccgttccctaaccgaaccctagtaccaacgtccgacgtcccgtgacctaaggttcgtagtaaacgtttgttttacggactttaagttttaatttacgtttggggactaaggtactaaggttatacgtagttacgtaacggttccgtacccgtacgtaaccttccccgggttaacccgttccgggggacccggtaaacgggggttaccaaaccggggtaacgttaaacgggaaaccttaaaacgggttaaaccgtacgtttcggacgggaccttacgtaacccgttaacgtttaacg

SEQ ID NO: 359933 - DNA, 650 bp, Homo sapiens
  misc_feature: GZ8MTXP01BTJO3.38.1.A01.1.454.CMB.2.raw
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (278)..(278): a, c, t, g, unknown or other
  misc_feature (278)..(278): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctcctgcgagggccagtcagagtgtagtaacactgctggtacatcagaaccnggcagcnccagactctnatctatgatcgcactcccaacgacgggccctacgtggtaccgtcccacggccgtaggttcgaggtcggactagggttgggtctaaggggaacctggtacgtttccacttcctaccaaccatacacgcacgcctggactagttaccgtagtaaacgttgttttacgactttaagtttttaatttacgtttagggtacgtaaggttacgtaagtttagtaggttaactacgttaacggttccggtaccccgttaccgtaccgttcccgtaaccggttacccgggaccgggtacggggaacctaacccggtaacgttaacgggaacttaaaacgtaaacggtacgtaacggtcgacgttacgccttaacgtaacg

SEQ ID NO: 359934 - DNA, 628 bp, Homo sapiens
  misc_feature: GZ8MTXP01CWJJJ.38.1.A01.1.454.CMB.2.raw
  modified_base (195)..(195): a, c, t, g, unknown or other
  misc_feature (195)..(195): n is a, c, g, or t
  modified_base (284)..(284): a, c, t, g, unknown or other
  misc_feature (284)..(284): n is a, c, g, or t
  modified_base (441)..(441): a, c, t, g, unknown or other
  misc_feature (441)..(441): n is a, c, g, or t
  modified_base (628)..(628): a, c, t, g, unknown or other
  misc_feature (628)..(628): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcagggccagtcagagtgtaagaacactgcctggtaccatcagaaacctggccaggctcccagacctcctnatctatgatcgacactcccacgagggccctagtcggtcgtcccagccgtaggttccaggttcggacgtagggtcggggtcgtaggggactgggtacgtttccaaccttccaccaacctataccgagcacggcctaggctacggtactaggtaagttnttttagactttaaggttttatttagttggggttaccaaggtcgtaagttatagtacgttacgaggttccggcccttaccggtaactcccggtaacccgtttcgggaccggtaaacggggcctaaacggtcgttaacggaaacttaaacgtaaaccgtagttcggacggcttacgaaccttaaccgtn

SEQ ID NO: 359935 - DNA, 598 bp, Homo sapiens
  misc_feature: GZ8MTXP01DPPQP.38.1.A01.1.454.CMB.2.raw
  modified_base (195)..(195): a, c, t, g, unknown or other
  misc_feature (195)..(195): n is a, c, g, or t
  modified_base (290)..(290): a, c, t, g, unknown or other
  misc_feature (290)..(290): n is a, c, g, or t
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
  modified_base (415)..(415): a, c, t, g, unknown or other
  misc_feature (415)..(415): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcagggccagtcagagttgttaagtaacaacctgcctggtaccatcagaacctggccaggctccagactctcatctangatgcactccaaccgngggcctacgtggtcgtcccagccgtaggttcaggtggctagggtcgggtcgtaggggacnggtattccaacttctacacctatcagcagcctgctagtctagtaagttntttgacttaagttttattagttcgggtactagtactaagttatcgtagttcgtaagggttcggtacccttaccggtactacccgtaacccggtttcgggacccggaaagggggttaccaaccggtacgttacggaaccttaaaagtaaacgtacgtcgggtggccttacgaaccaaccgttaa

SEQ ID NO: 359936 - DNA, 789 bp, Homo sapiens
  misc_feature: GZ8MTXP01BJLUE.38.1.A01.1.454.CMB.2.raw
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
tcagtcgatcacgtcacgaccggtgctcgatttagacgtctcatcagggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggaggagcgccctcctctcgngacgacgcngtagagtagttagtaactaacctacgtcgtacgtacgtactacgacgaaccgtacggcggacgacgccctacgacgtcctcctatactactagtgtatcgactaccgtaccccgacgggacgtacctacggttccggtcccgtaccgccggtaccgttacggtacgtacggggtccggacgggttggggtcgggtacgggtacggtaaacgtaacggtttccgtacctaccgtaccctacccaacgtactacgacgacgtccgtccgtaggtaacccgttaggttaggttaaaggttaatttttcgtttacggtaacgtttttaaattttagtttacgtttaccggaacggtaacggtttacggtttaaaatcgggttaactaaccgttcggggtaaccggtttcccgtacccctacggtaccttaccccggttacgggggaaccccggaaagggggttaaccggaaacccttacgggttaaaccggaacgttaaaaaccgttaaaacggttaaaccgggttgttcccgggcttaacccggacgttaacccctaagtttcgttttcccg

SEQ ID NO: 359937 - DNA, 554 bp, Homo sapiens
  misc_feature: GZ8MTXP01AS1F5.38.1.A01.1.454.CMB.2.raw
  modified_base (554)..(554): a, c, t, g, unknown or other
  misc_feature (554)..(554): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcgagggccagtcagagtgttagtaacactagcctggtaccatcagaaacctggccaggcctcccagacctccctcatctatgatgcactcccaacgcgggccacgtcggtcgtcccagccctaggttcaggtggcgtagggtcggggtcgtaaggggactaaggtacgtttccactctacaccatcagcacgcctgcagtctaggattacttgacttagtttattagtgggtacagtctagttatgatcgagttcgaccctcgtatccaaccggttcggcgaacgggccaacggacttaggaaacttaaaggaaaccgagtggtcggacttcgcaaccgtn

SEQ ID NO: 359938 - DNA, 547 bp, Homo sapiens
  misc_feature: GZ8MTXP01BHVVV.38.1.A01.1.454.CMB.2.raw
  modified_base (297)..(297): a, c, t, g, unknown or other
  misc_feature (297)..(297): n is a, c, g, or t
  modified_base (361)..(361): a, c, t, g, unknown or other
  misc_feature (361)..(361): n is a, c, g, or t
  modified_base (404)..(404): a, c, t, g, unknown or other
  misc_feature (404)..(404): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtcctccgaggggagagacgcccaccctctcctgcagggccagtcagagtgttagtaacaacctagcctggtaccatcagaaacctggccaggcctcccagacctcctcatctangatgcactcccacgagggccacgtggtctcccagccaggtcagtggcaggtgggtctagggacngtactcactctcaccatcagcacgcctgctagtctagtaagtntttgacttagtttacttagttgtactagtctagttatgattcgaggtcggtccctaccgatccgtaaccgttcgggaccgtaggggaccacggacttagggaacttaaagtaaacgacgtggtcggcttacgccaacgtaacg

SEQ ID NO: 359939 - DNA, 578 bp, Homo sapiens
  misc_feature: GZ8MTXP01BXTLV.38.1.A01.1.454.CMB.2.raw
  modified_base (195)..(195): a, c, t, g, unknown or other
  misc_feature (195)..(195): n is a, c, g, or t
  modified_base (284)..(284): a, c, t, g, unknown or other
  misc_feature (284)..(284): n is a, c, g, or t
  modified_base (402)..(402): a, c, t, g, unknown or other
  misc_feature (402)..(402): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctaaacccagaaatcactggagaaatcgtgatgacgcagtctccagccacctgtctgtgtctccgagggganagagccacctctcctgcagggccagtcagagtgttaagtaacaacctagcctggtaccatcagaaacctggccaggcctccagactccnatctatgatgcatcccaaccgagggccagtggtctcccagccaggttcaggtcggctaggtcgggtctgggaacagtcgttcactctacaccatcagcagcctgcagtctagaagttntttgacttaagtttattagttcgtacgagtctaagttatgtaactcgtaggtcgtccctccgtatccgtaacccgttcgggaccgaacgggggtaacccaacgggaaccgttacgggaaacttaaacgttaaaaccgtaacgtggttaacggctacggacctaacgttaacgttcg

SEQ ID NO: 359940 - DNA, 655 bp, Homo sapiens
  misc_feature: GZ8MTXP01ADKEF.38.1.A01.1.454.CMB.2.raw
  modified_base (195)..(195): a, c, t, g, unknown or other
  misc_feature (195)..(195): n is a, c, g, or t
  modified_base (292)..(292): a, c, t, g, unknown or other
  misc_feature (292)..(292): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcgagggccagtcagtagtgttagtaaccactagcctaggtaccatcaagaaacctggccaggcctcccagacctcctnatctatgatcgcactccgaccgagggccctagttggtcgtaccccagcccgtagggttcaggtcggacgtagggttcggggtcgtaaggggacaacgggttagttcccaactttcccacaaccctatcacgaccacggcctaggctagtacgtaggtaaacgtttgttttagacgtttaaggttttactttagttaggggtacgtagtaccgtaaggttaactggtaactaccgtaggttccggacccttacccggtacttcccgttaacccggttcgggacccggaaagggggacctaccgggtaagttacgggaaacaaacgtaaacggtacgtgggtacggcttacgccgaaccgttaag

SEQ ID NO: 359941 - DNA, 595 bp, Homo sapiens
  misc_feature: GZ8MTXP01B3T3Q.38.1.A01.1.454.CMB.2.raw
  modified_base (276)..(276): a, c, t, g, unknown or other
  misc_feature (276)..(276): n is a, c, g, or t
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagtaacaacctagcctggtaccatcagaaacctggccaggctccanactcctcatctatgatncacnccaccgacggccgacgtcggtcgtccacgaccgacgttcgtacggtggcgaggtgggtcgtagggacgaagtagtctactctcacactcagcacgcctcgcagtactagtaagtagtttagttctagtttaatttatttggttcgtagacgtagtagtagtacgtacgtacgtcggtccgtccgtacctacctaaccgtccggttaccggtacgggaacggaaccggtaacgttacggaacgaaaacgtaaaacgtaaaacgtaacggtacggtcggttacgtaaccgaaccgtaacg

SEQ ID NO: 359942 - DNA, 587 bp, Homo sapiens
  misc_feature: GZ8MTXP01BVK2B.38.1.A01.1.454.CMB.2.raw
  modified_base (193)..(193): a, c, t, g, unknown or other
  misc_feature (193)..(193): n is a, c, g, or t
  modified_base (290)..(290): a, c, t, g, unknown or other
  misc_feature (290)..(290): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcagggccagtcagtagtgttagaacacctagcctggtaccatcagaacctggccaggcctcccagactcctcatctangatgcatcccaacgagggcccagtggtcgtcccagtcccaggttcaggtcggctaggtggggtctaggggaactaggtaacgttccacttcctaccaacctatcaagcagcctgctagtcgtagtaagttattttgacttagtttattatttgtacagtctagttagtgtaatcgtaggttcggtcccttaccggtaacttccgtacccgttaacggccgaagggggtaccacggtacgtacggaaacttaaagttaaaccgaagttggaaggtctacgcctaaccttaagttcccg

SEQ ID NO: 359943 - DNA, 628 bp, Homo sapiens
  misc_feature: GZ8MTXP01AKODR.38.1.A01.1.454.CMB.2.raw
  modified_base (198)..(198): a, c, t, g, unknown or other
  misc_feature (198)..(198): n is a, c, g, or t
  modified_base (367)..(367): a, c, t, g, unknown or other
  misc_feature (367)..(367): n is a, c, g, or t
  modified_base (385)..(385): a, c, t, g, unknown or other
  misc_feature (385)..(385): n is a, c, g, or t
  modified_base (410)..(410): a, c, t, g, unknown or other
  misc_feature (410)..(410): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagcccaccctgtctgtgtctccgaggggganagacgcccaccctctcctgcagggccagtcagagtgttagtaacaacctagcctggtaccatcaagaaacctggccaggcctcccagacctcctcatctatgatgcactcccacgaggggcccagtggtctcccagccaggttcaggtggcaggtgggtctaggggacngtacgttcactcacaccntcagcagcctgcagtctagtaagtntttgacttaagtttattagttcggtacaaggtctaaggttataggtacttcgtaacgggtccggtaccccttaccggtaacttccccgtaaccccggtttcggggaccccggtaacgggggaaaccctaaccgggtaaccgttacggggaaaaccttaaaacggttaaaacccgggtacgttgggttcgggaccttacggaacccttaaccgttaacg

SEQ ID NO: 359944 - DNA, 552 bp, Homo sapiens
  misc_feature: GZ8MTXP01DDOUG.38.1.A01.1.454.CMB.2.raw
  modified_base (196)..(196): a, c, t, g, unknown or other
  misc_feature (196)..(196): n is a, c, g, or t
  modified_base (314)..(314): a, c, t, g, unknown or other
  misc_feature (314)..(314): n is a, c, g, or t
  modified_base (546)..(546): a, c, t, g, unknown or other
  misc_feature (546)..(546): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcagggccagtcaagagttgttagtaacaacctagcctggtaccatcaagaaacctggccaggcctccccgagacctcctcatcgatgatgcactccacgngggccacgtggtctcccagccgaggttcaggtcggcagggtgggtccgtaaggggactggtgtccacttctacacatcagcaggcctgctagtctagtaatgtttcgattagtttattagttggactagtactaggttatgtactcgtaagtcggtaccctcgtactccgtaaccgttcgggaccgagggttcacggtacttaggacaaagtaaccgatggagtcttcgccncgtaac

SEQ ID NO: 359945 - DNA, 667 bp, Homo sapiens
  misc_feature: GZ8MTXP01DJB6A.38.1.A01.1.454.CMB.2.raw
  modified_base (196)..(196): a, c, t, g, unknown or other
  misc_feature (196)..(196): n is a, c, g, or t
  modified_base (468)..(468): a, c, t, g, unknown or other
  misc_feature (468)..(468): n is a, c, g, or t
  modified_base (517)..(517): a, c, t, g, unknown or other
  misc_feature (517)..(517): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctctgcgagggccagtcagtagtagttaagaaccaacctagcctaggtaccatacaagaaacccgtggaccaggccctacccgaagtaccttcctacacttctaatgatcgaccactaccccgaaccggacggggcccctaacggtttcgggtaccgtaccccgagacccgtaggtttccaagggtcgggactaggggtcgggtacgtaaggggactaaggtacttccaacttcaccacctatcagcacgctgctagtntagtaagttgttttagactttaagtttattacgttaggtactaacggtntaaggttatagtacgtacgtacgtccggtccctaccgtacgttccgtaaccggttccgggacggtaacggggactaacggacgttaacgggaaacttaaaacggttaaacgacgttaacggtcggtaccttacgtcccttaaccgtaacg

SEQ ID NO: 359946 - DNA, 593 bp, Homo sapiens
  misc_feature: GZ8MTXP01DVFGM.38.1.A01.1.454.CMB.2.raw
  modified_base (194)..(194): a, c, t, g, unknown or other
  misc_feature (194)..(194): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccacctgtctgtgtctccgagggganagacgcccacctctcctgcagggccagtcagtagtgttaagtaacactagcctagtaccatcaagaaccgtggccaggcctccccagacctcctacatctatgatcgaccactccccgaaccgagggcccctacgttcggtccgtacccccaggcccgtaaggggtttccaagggttcggacgtagggttcggggtcctaagggggaactaaggtacgtttccaccttcctaccaaccatccagcacggcctgaccaggttactagtaagttattttgacttagtttattagttgggtactagtctagtatgatcgagtcgtccttcgactcgaaccttcggcgtagggcacgaacttaggaacaaagtaacgacgtgtcggcttacgccttaacgtaa

SEQ ID NO: 359947 - DNA, 681 bp, Homo sapiens
  misc_feature: GZ8MTXP01B6T7Q.38.1.A01.1.454.CMB.2.raw
  modified_base (532)..(532): a, c, t, g, unknown or other
  misc_feature (532)..(532): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcgagggccagtcagagtgttaagaacacctgcctggaccatcagaacctggccaggcctaccagacctcctcatcctatgatcgcctactccccgaaccgacggggcccctacgttcgggttaccgtcccccaggccccgtaagggtttcaaggggttcgggaccgtaggggttgggggtccgtagggggaaacagggtcgtttccaaccttcctaccgacccaagttcccgaacgtacctacgcccgttgggacctaggttaccgtaaggttaaacgttatttttcggactttagttttaatttagtttgtacgtaggtntaaggttagtgtacttcgtaaggttccggcccttaccgattcccgtaacccggttccgggacccggttacgggggaccacggtaacgtacggaaacgttaaacgttaaaccgaacgttagggtcgcgtacgcctaacccttaagttccg

SEQ ID NO: 359948 - DNA, 588 bp, Homo sapiens
  misc_feature: GZ8MTXP01C9CUM.38.1.A01.1.454.CMB.2.raw
  modified_base (196)..(196): a, c, t, g, unknown or other
  misc_feature (196)..(196): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (318)..(318): a, c, t, g, unknown or other
  misc_feature (318)..(318): n is a, c, g, or t
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccaggggganagacgccaccctctcctgcagggccagtcagagtgttagtaacaacctagcctggtaaccatcagaaacctggccaggctcccagactcctnatctangatgcatccaacagggccactggngtcccagccaggttcagtggcagtgggtctgggacngagttcaactcacaccgtancagacacgctcgctagtacgtagtaagtagtttagtacttaagtttaatttagtttaggttacgtagtacgtaagtaagtagtagtacgtacggtcggtccgtaccgtactcgtaacccgttccggttaccggacggggaacggaacgaacgttaacggaacgaaaacgtaaaacgtaaacgtaacgtcggtacgttacgtccgaaccgtaacg

SEQ ID NO: 359949 - DNA, 624 bp, Homo sapiens
  misc_feature: GZ8MTXP01DAF1F.38.1.A01.1.454.CMB.2.raw
  modified_base (193)..(193): a, c, t, g, unknown or other
  misc_feature (193)..(193): n is a, c, g, or t
  modified_base (300)..(300): a, c, t, g, unknown or other
  misc_feature (300)..(300): n is a, c, g, or t
  modified_base (443)..(443): a, c, t, g, unknown or other
  misc_feature (443)..(443): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctccagaaatcactggagaaatcgtgatgacgcagtctccagccaccctgtctgtgtctcgagggganagacgcccaccctctcctgcgacgggccagtcgaagtagttagttaacgtaaacaacctagccctggtaaccatcaagaaacctggaccagcctacccagactccanatcatgatgcatcccacgacgggccatggtcgacccagccctaggttcaggtggacgtaggtcggggtcgtaagggataagggtactttcccaacttccaccaaccgataccagactagccctagcagttactagtaaagttntttagagtttatttattagttaggtacgtagtactagttagtgtacgtcgtacggtccggtacctaccgtacttccgaaccgttccgggacggaacgggttaccgaaacggtaacgttaacggaaacttaaaacgtaaacggtaacgtggtcggtacgttaccgtaaccgttaaccgtaag

SEQ ID NO: 359950 - DNA, 709 bp, Homo sapiens
  misc_feature: GZ8MTXP01DFEVF.38.1.A01.1.454.CMB.2.raw
  modified_base (194)..(194): a, c, t, g, unknown or other
  misc_feature (194)..(194): n is a, c, g, or t
  modified_base (299)..(299): a, c, t, g, unknown or other
  misc_feature (299)..(299): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagagcccaccctctcctgcgagggccagtcagtagtgttaagtaacaacctgcctaggtaccatcaagaacctggaccaggcctcccagtacctcctacatctangatcgaccatccccgaaccgtagggccctacgtcgggttccgccccagccccgtagggttcagggtcgggaccgtaggttcgggggtacctagggggaaactagggtcgtttaccaaccttccgtacccaaccctagtcccgaagcctacgccgtcgacgtacggttacgtaagtaacgtttattttacggtactttaagtttattttaagtttcggtacgtaacgggtacttaaaggttatagtaacgttcgtacgggttccggtaccctcccggtaactcccgtaacccggtttccgggaacccggttaggggaaccttaccggtaaacgtacggttaaaaccgttaaacgttaaaaccggtaaccgttgggtaacggtacgtaccggacctaaccgttaacgttccg

SEQ ID NO: 359951 - DNA, 587 bp, Homo sapiens
  misc_feature: GZ8MTXP01EFWBX.38.1.A01.1.454.CMB.2.raw
  modified_base (193)..(193): a, c, t, g, unknown or other
  misc_feature (193)..(193): n is a, c, g, or t
  modified_base (286)..(286): a, c, t, g, unknown or other
  misc_feature (286)..(286): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttaagaacaacctagcctggtacccatcaagaacctggccaggcctcccagacctccncatctatgatgcactcccaccgagggccacgtcggtctcccagccgtaggttcagtcggcgtaggtcgggtctaggggaacctaggtcgtttccaaccttctaccaacctagtcacggccacggtccctggctaggttctaggtaaagtttatttttcggactttaagttttattaagttggttacaaggtctaagttagtgattcgaggttccgccttcgatcccgtaacgtcggacgaggggtacaacgacgtagggaaacaagttaaacgcgtggtcgctagacctaaccttgttccg

SEQ ID NO: 359952 - DNA, 734 bp, Homo sapiens
  misc_feature: GZ8MTXP01AGQ1W.38.1.A01.1.454.CMB.2.raw
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccgaggggagagacgcccaccctctcctgcagggccagtcagtagtgttaacgtaacaccgtagcctgtaccatcacgaaacctggccacggcctcccagacctccctacatctangatcgcactccgaccgngggcctacgtggtcgtcccagccgaggttcaggtcggcgagggtcgggtgtaacgggactaagtacgttccaaccttcgtaccaaccacttacgacggtaccgaccggtccccgttaggaccgtacggttaccgtaagttaaacggttagtttttacggtactttaaagttttttaacgtttagttttacgggggtactaaggttaccgtaagggttttaactggttaacgtaccggttacgggtcccggtaccccgttacccggtacgtttcccccgggtaaccccgggtttaccggggaacccgggtaacgggggttaacccgtaaacgggtaacccgttaacgggaaaacccgttaaaacgtaaaccgggttacgtcgggtacggtaccttaccgtaacccgttaaccgttg

SEQ ID NO: 359953 - DNA, 764 bp, Homo sapiens
  misc_feature: GZ8MTXP01A940W.38.1.A01.1.454.CMB.2.raw
  modified_base (194)..(194): a, c, t, g, unknown or other
  misc_feature (194)..(194): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggcctcccagaaatcactggagaaatcgtgatgacgcagtctccagccaccctgtctgtgtctccgagggganagacgcccaccctctccgtgcagggccagtcagagtgttaagaacacctgcctaggtaccatcagaaacctggccaggcctcccagacctcctcatctatgatgcatccccacgagggccagtcgggtctcccagccctaggttccaggttcggcgtaggtggggtctggggaaaccaggtaacgttcaaccgttctacccgaaccctaagtccgaacgccgtacgtccccgttaggaccgtaacggttaccgttaagggtaaacgtttagttttttacggaacctttaaggttttttaacttttaagtttcgggttaaccgtaaggggttaccttaaaggtttaacgttaggtaaactttccggtaacggggtttcccggggtacccctttaccccgggtaacttaccccggttaaccccgggtttaacccggggaaccccgggttaaacggggggtaaacccacccggggtaaacgttaacggggaaaaccgttaaaacggttaaaacccggtaacgttacgggtaacgggtaccttaccggaacccgtaacccgttaacgtttcccg

SEQ ID NO: 359954 - DNA, 633 bp, Homo sapiens
  misc_feature: GZ8MTXP01BDKH5.38.1.A01.1.454.CMB.2.raw
  modified_base (193)..(193): a, c, t, g, unknown or other
  misc_feature (193)..(193): n is a, c, g, or t
  modified_base (433)..(433): a, c, t, g, unknown or other
  misc_feature (433)..(433): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcagggccagtcagagtgtagtaacaacctagcctaggaccatcaagaacctggccaggcctcccagacctcctacatctatgatcgacactccccaaccgacggggccctacgttcgggtcgtccccgagcccgtagggttcaggtcggctagggtggtcgtgggaactagtcgtcacctcgaccactatcagccagtccctgacctagtcgtagtagttntttcgagttagtttattagttcgacggtagtacgtagttacgtgtacttcgaggttcccggccttaccgtattccccggtcccggttaaccgggaccggttaaacgggggaccttacggtaaccgtaagggaaaaccttaaaggttaaaacccggccgttggtaacgggtaccctacggacccttaacgttctttaaccg

SEQ ID NO: 359955 - DNA, 585 bp, Homo sapiens
  misc_feature: GZ8MTXP01DU6RZ.38.1.A01.1.454.CMB.2.raw
  modified_base (195)..(195): a, c, t, g, unknown or other
  misc_feature (195)..(195): n is a, c, g, or t
  modified_base (294)..(294): a, c, t, g, unknown or other
  misc_feature (294)..(294): n is a, c, g, or t
  modified_base (487)..(487): a, c, t, g, unknown or other
  misc_feature (487)..(487): n is a, c, g, or t
  modified_base (558)..(558): a, c, t, g, unknown or other
  misc_feature (558)..(558): n is a, c, g, or t
  modified_base (563)..(563): a, c, t, g, unknown or other
  misc_feature (563)..(563): n is a, c, g, or t
  modified_base (579)..(579): a, c, t, g, unknown or other
  misc_feature (579)..(579): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtcctccagcccaccctgtctgtgtctccgagggganagacgcccaccctctcctgcgagggccagtcagtagtgttaagaaccaacctagcctaggtacccatcaagaaacctggccaggcctcccagcctcctnatctatgatcgacactccccgaaccgagggcccctagtcgggtcctccccgagcccgtaggttcaggtccggcgtagggtgggtctaggggaacagtcgttcaccgtctaccacatcacgtcacgtcctgctagttctaaggttagttacttttgacgttagttttacttagttcgtacgtagtatagttagngtatccgtagtccggtaccctcgtactcccgacgtcggacgacgggacaggaacgtgaacaaagttaacgngtcgngacctcgactaaccgnttcccg

SEQ ID NO: 359956 - DNA, 659 bp, Homo sapiens
  misc_feature: GZ8MTXP01CDBYN.38.1.A01.1.454.CMB.2.raw
  modified_base (196)..(196): a, c, t, g, unknown or other
  misc_feature (196)..(196): n is a, c, g, or t
  modified_base (304)..(304): a, c, t, g, unknown or other
  misc_feature (304)..(304): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagcccacctgtctgtgtctccgagggganagacgccccaccctctcctgcgagggccagtcagtagtgttaacgtaacaacctagcctaggtaccatacaagaaaccctggacccaggcctaccccagtacctcctnatctatgatcgaccactccccgaacgcgggaccctacggtcggtcgtaccccgagtcccgtagggttccaggtcgggacgtagggtcggggtacgtaagggggaactggggtactttccaaccttccgaccgaccctaatccgacgcacggcctgcgtaggtctagtaagtttgttttagactttaagttttattacgtttggggactagtactaaggttatcgaacttcgtaaggtccggtaccttccgtaactcccgtaaccggttcgggaccggacggggaacctaccggtacgttaaggaaacccaaagtaaacccggtagtcggttacggacttacgccgttaacgttcg

SEQ ID NO: 359957 - DNA, 519 bp, Homo sapiens
  misc_feature: GZ8MTXP01DS9IN.38.1.A01.1.454.CMB.2.raw
  modified_base (194)..(194): a, c, t, g, unknown or other
  misc_feature (194)..(194): n is a, c, g, or t
  modified_base (359)..(359): a, c, t, g, unknown or other
  misc_feature (359)..(359): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagcccaccctgtctgtgtctccgaggggganagagcccaccctctcctgcagggccagtcagagtgttagtaacaacctagcctggtaccatcagaaacctggccaggcctcccagactcctcatctatgatgcatcccaacagggccacgtggtcgtcccagccaggttcagtggcaggtgggtctgggaacagngttcactctcaccatcagcagcctgcagtctagaagtatttgacttagtttattattgtctagctagtatgattcagttcggcctccgatccaccgttcggcgaggggacacgactgggaaacagttaaaacgaacgtgtcggctgcctaacaacgttcg

SEQ ID NO: 359958 - DNA, 552 bp, Homo sapiens
  misc_feature: GZ8MTXP01BNK29.38.1.A01.1.454.CMB.2.raw
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (354)..(354): a, c, t, g, unknown or other
  misc_feature (354)..(354): n is a, c, g, or t
  modified_base (395)..(395): a, c, t, g, unknown or other
  misc_feature (395)..(395): n is a, c, g, or t
  modified_base (427)..(427): a, c, t, g, unknown or other
  misc_feature (427)..(427): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggcctcccagaaatcactggagaaatcgtgatgacgcagtctccagccaccctgtctgtgtctccgaggggagagacgcccaccctctcctgcagggccagtcagagtgtagaacactagcctggtaccatcagaactgcagctccanctcnatctangatgcactcccacgacgggccacgtggtcgcccagccaggttcaggtgcgtagggtcgggtcctaaggggacnggtacgtttcacgtcctacaccatccacgcacgcctgaccngttactaggtaatcgtttgacttagtttattnttggtacgtagatagttatgtactcgtacggtcgtcctcggtaccttcgtaaccggtcggaccgtacggggacacggtacgttagaacttaaactaagacgtcgtgggccttcggccttaacgtg

SEQ ID NO: 359959 - DNA, 532 bp, Homo sapiens
  misc_feature: GZ8MTXP01AIZXA.38.1.A01.1.454.CMB.2.raw
  modified_base (193)..(193): a, c, t, g, unknown or other
  misc_feature (193)..(193): n is a, c, g, or t
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
  modified_base (342)..(342): a, c, t, g, unknown or other
  misc_feature (342)..(342): n is a, c, g, or t
  modified_base (344)..(344): a, c, t, g, unknown or other
  misc_feature (344)..(344): n is a, c, g, or t
  modified_base (360)..(360): a, c, t, g, unknown or other
  misc_feature (360)..(360): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctccagaatcactggagaaatcgtgatgacgcagtctccagccacctgtctgtgtctccgaggggganaggacgccaccctctcctgcagggccagtcagagtgtagtaacactgcctggtaccatcagaacctggccaggctccagactctcatctangatgcatccacgnggccatggtctccagccaggttcagtggcaggtgggtctgggacngngtcactctcacatcancagcctgcagtctagtaatatttgacttagtttattattggtcagctagtatgtatacgtagtcggtcctcggtacttccgaaccgttcgggaccgaagggggacctaacgggacgttacgggacaaagtaaaacggtacgtaaggttcggacttcggaacgttcccgtaag

SEQ ID NO: 359960 - DNA, 630 bp, Homo sapiens
  misc_feature: GZ8MTXP01A0UQR.38.1.A01.1.454.CMB.2.raw
  modified_base (196)..(196): a, c, t, g, unknown or other
  misc_feature (196)..(196): n is a, c, g, or t
  modified_base (603)..(603): a, c, t, g, unknown or other
  misc_feature (603)..(603): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagcccacctgtctgtgtctccgagggganagacgcccaccctctcctgcgagggccagtcagagtgttaagaacactgcctaggtaccatcaagaacctggccaggcctccgagacctcctcatctatgatcgcactcccacgacgggccacgtggctcccagccgtaggttcacggtcggcgtagggttcgggtactaggggactaaggtcgttaccactcctaccacatcgacgcacggcctgaccgtagtactagtaagttattttaggactttaaggttttatttacgtttacgggtaccgtaaggtccgttaaggttacgtggtaacttcgggtaacgggtttcccggccccgttacggtacctcccggtaaccggttcgggacccgggtaagggaccctaacggcgttaacggaacttaacgtaaaacgngtcgtacggcttacgaaccttaacgtc

SEQ ID NO: 359961 - DNA, 581 bp, Homo sapiens
  misc_feature: GZ8MTXP01DZTY1.38.1.A01.1.454.CMB.2.raw
  modified_base (193)..(193): a, c, t, g, unknown or other
  misc_feature (193)..(193): n is a, c, g, or t
  modified_base (383)..(383): a, c, t, g, unknown or other
  misc_feature (383)..(383): n is a, c, g, or t
tcagtcgatcacgtcacgaccggtgctcgatttagacgtctcatcagggggggaactgctcagttaggacccagacggaaccatggaagccccagcgcagcttctcttcctcctgatactctggctcccagaaatcactggagaaatcgtgatgacgcagtctccagccacctgtctgtgtctccgagggganagagcccacctctcctgcagggccagtcagagtgttagaacactgcctggaccatcagaacctggccaggcctcccagtacctcctcatctatgatcgacatcccacgagggccagtcggtctcccagtcctaggttcaggtcggcgtaggtcgggtctggggaactagtcgttcaactcacaccatcancagcctgctagtctagattatttgacttagtttatattcgacagtactagtatggtactcgtaggtccggtaccctcggtaacttcccgtaccggttccgggaccggaacgggggtacccaacggtaaaccgttacggaaaaccttaaacggttaaaacccgtggtacggtcggcctcggacctaacccgttgttccg

SEQ ID NO: 359962 - DNA, 574 bp, Homo sapiens
  misc_feature: GZ8MTXP01B0X22.38.1.A01.1.454.CMB.2.raw
  modified_base (196)..(196): a, c, t, g, unknown or other
  misc_feature (196)..(196): n is a, c, g, or t
  modified_base (556)..(556): a, c, t, g, unknown or other
  misc_feature (556)..(556): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggganagacgcccaccctctcctgcagggccagtcagtagtgttaagtaaccaacctgcctggtaccatcagaaacccgcacggctcccagactcctcatctatgatgcatccaccgacggccactgggtctcccagccgtaggttcaggtcggcgtaggtgggtcagggaaccagtcgttctacctctaccacaactcaacgcacgcccgtgccgtagtcgtaagtaagtagttttgattagtttattattgtcgagtactagtatagatcgtagtcgtccgttccgacttccgtacccgttcggaccgaagggggtaccacggtacgtagggaacaaacgttaaacgaacgtaggtcgtcganacctaacgttaacgttcg

SEQ ID NO: 359963 - DNA, 644 bp, Homo sapiens
  misc_feature: GZ8MTXP01DWVXL.38.1.A01.1.454.CMB.2.raw
  modified_base (194)..(194): a, c, t, g, unknown or other
  misc_feature (194)..(194): n is a, c, g, or t
  modified_base (286)..(286): a, c, t, g, unknown or other
  misc_feature (286)..(286): n is a, c, g, or t
tcagtcgatcacgtcacgaccggtgctcgatttagacgtctcatcagggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccacctctcctgcagggccagtcagagtgttaataacaacctagcctggtacccatcagaacctggccaggcctcccagacctcctnatctatgatgctactccccacgacgggccctacgtcgggtacgtacccccgagtcccgtaagggttcagggttcgggccgtaggggtttcgggggtctaggggggaaaccctaagggtcgtttaccacctttccctaccaacccgattccgaagccgacgccgttaggctagttactaggtaagtttagttttcgactttaagttttattagtttcgtacgtaaggtcttaagttattggacttcgtaggtccggtccctccgtacgtcccgtcccggtcggaccggaggggaccttacggacgtaggaaacttaacgttaaacggtcgtggtcggctcgacctaacgttaactttcg

SEQ ID NO: 359964 - DNA, 564 bp, Homo sapiens
  misc_feature: GZ8MTXP01A4D4Z.38.1.A01.1.454.CMB.2.raw
  modified_base (194)..(194): a, c, t, g, unknown or other
  misc_feature (194)..(194): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggganagagcccaccctctcctgcagggccagtcagagtgttagtaacaactagcctggtaccatcagaaacctggccaggcctcccagactcctcatctatgatgcactccaccgagggccacgtggtcgtcccagccaggttcaggtcggcgtaggtgggtcgtggggaacaggtaagttcaccgtctacgaccagtcaagccagcctgccgagtctagaagttatttgacttagttttattatttggcagtacagttatgtatcgagtcggcctaccgattccgaacgttcggccgttaagggggcacggtactacgggaacaaacgttaaacggtaactgggtaacggctcggacctaacgttaagttccg

SEQ ID NO: 359965 - DNA, 720 bp, Homo sapiens
  misc_feature: GZ8MTXP01BFUCL.38.1.A01.1.454.CMB.2.raw
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctcctgcgagggccagtcagtagtgttaagtaacaacctagcctaggtaccatacaagaaacctggaccaggcctcccagacctcctcatctatgatcgcactccccgaaccgacggggcccctacgttgggtccgtacccccgaaggcccgtaaggggtttccaaggttcgggacgtaaggggttcggggtccgtaagggggaacctaagggtacgtttcccaaccgttcctaccaaccctataccgagccacggtccctgggacctaggttcgtaaggtaaacgttttcgttttacgacttttaagttttaatttacgtttacgggtacgtaggtacttaaggttatacgtacttacggtacggtccggtaccccgtaccggtaccgttcccggtaacccggttcgggggacccgggtaacggggaaccgtaaccgggtaacggttaacgggaaaacttaaaacggtaaacggtacggtgggtacggtcgttacgaacccgttaacgtg

SEQ ID NO: 359966 - DNA, 521 bp, Homo sapiens
  misc_feature: GZ8MTXP01BHPYV.38.1.A01.1.454.CMB.2.raw
  modified_base (356)..(356): a, c, t, g, unknown or other
  misc_feature (356)..(356): n is a, c, g, or t
  modified_base (427)..(427): a, c, t, g, unknown or other
  misc_feature (427)..(427): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcagggccagtcagagtgttagaaccaacctagcctggtaccatcagaaacctggccaggctcccagactcctcatctatgatgcatccacgagggccagtgggtctcccagcctaggttcagtggcaggtgggtctgggaacagngttcactctcacatcagcagcctgcagtctagaagtatttgcttagtttatattgtcagtcagtatgactnaggtcggccttcgactccaccgttcggcccgttagggggacacggtactgggaaccttaagttaaacgaactggtaagctcgacaaccgttgtc

SEQ ID NO: 359967 - DNA, 621 bp, Homo sapiens
  misc_feature: GZ8MTXP01BS4VU.38.1.A01.1.454.CMB.2.raw
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccacctgtctgtgtctccgaggggagagacgccaccctctcctgcagggccagtcagtagtgttagtaacacctagcctagtaccatacagaacctggccagcctaccagactcctnatctangatgcactcccgaacgcgggcccacggtggtccgtcccagccgtaggttcaggttggcgtagggtcggggtctacgggggactggtacgttccacttccgacaccatccagcagcctgactagttctaagtaagttattttgactttaagtttattagttgggtactaagtctaagtatggtactcgtacggtccggtaccctaccgtacgttcccgtaacccggttcgggacccggtaacgggggacctaacgggtaaccgttaaggttaaaccttaaaacgtaaacggtacgtggtcgggtaccttacggtaacccttaacgtaacg

SEQ ID NO: 359968 - DNA, 570 bp, Homo sapiens
  misc_feature: GZ8MTXP01AY0LX.38.1.A01.1.454.CMB.2.raw
  modified_base (194)..(194): a, c, t, g, unknown or other
  misc_feature (194)..(194): n is a, c, g, or t
  modified_base (283)..(283): a, c, t, g, unknown or other
  misc_feature (283)..(283): n is a, c, g, or t
  modified_base (423)..(423): a, c, t, g, unknown or other
  misc_feature (423)..(423): n is a, c, g, or t
  modified_base (564)..(564): a, c, t, g, unknown or other
  misc_feature (564)..(564): n is a, c, g, or t
tcagtcgatcacgtcacgaccggtgctcgatttagacgtctcatcagggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcagggccagtcagagtgtagtaacactagcctggtaccatcagaaacctggccaggcctcccagacctcnatctatgatgcatcccaaccgagggcccacgtgggtcgtcccagccgaggttcaggtcggcaggtgggtctggggaacaggtcgttcactctcaccatcagcacgcctgcagtctagagttgtttgacttagtttacttnttgtacgagtctagttatgtatcgaggttcggccctccggtactccgtacccggttccgggaccgttaacgggggacaccggtacgtacggaacgttaaagttaaaccgaacgttggtaacggtcgtcgacctaacccttnttcccg

SEQ ID NO: 359969 - DNA, 638 bp, Homo sapiens
  misc_feature: GZ8MTXP01EK4HS.38.1.A01.1.454.CMB.2.raw
  modified_base (193)..(193): a, c, t, g, unknown or other
  misc_feature (193)..(193): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (430)..(430): a, c, t, g, unknown or other
  misc_feature (430)..(430): n is a, c, g, or t
  modified_base (465)..(465): a, c, t, g, unknown or other
  misc_feature (465)..(465): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcgagggccagtcagagtgttagtaacaactagcctggaccatcagaacctggccaggcctccagtactcctnatctaatnatcgcatcccacgagggcctagtcggtctcccgagccctaggttcaggtcggactagggtcgggtctaggggaacaggtcgttccactcaccacctagtcaagtccaggtccctgacgtagttacgtaggtaaagtttnttttaggcttaagttttattagttcgtataaggtnttagttagtacgtatccgtaggtccggtcccttaccggtaattccccgtaaaccgggtttccgggaaccggacgggggtaaacccttccgaacggttaacgggaaaacgttaaaacgttaaacccggaattgggaacgtaccgttcggaaccctaaccggttaattttccccg

SEQ ID NO: 359970 - DNA, 656 bp, Homo sapiens
  misc_feature: GZ8MTXP01AYHYA.38.1.A01.1.454.CMB.2.raw
  modified_base (193)..(193): a, c, t, g, unknown or other
  misc_feature (193)..(193): n is a, c, g, or t
  modified_base (289)..(289): a, c, t, g, unknown or other
  misc_feature (289)..(289): n is a, c, g, or t
  modified_base (454)..(454): a, c, t, g, unknown or other
  misc_feature (454)..(454): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagtagtgttaagaacaactagcctggtaccatcaagaaacctggcccaggcctacccagacctcctnatctatgatcgcactcccaacgagggccctacgtgggtcctcccgagccctaggttcaggtcggacctaggggtcgggtcgtgggggaaacctaggtaacgttccaacttccctaccaacctatccgaagccacggtccctgaccgtagttcgtaggtaaagttntttttaggactttaagttttaattacgttggtacagtactaagttataggataccgtaggttccggtacccttccggtacttacccgtaacccgggttcccgggggaacgacggggggtaacccaccgggtaagttaaccgggaaacttaaaacggttaaacgaacgttgggtaacgcgtcgacccaaccgttaacgttccg

SEQ ID NO: 359971 - DNA, 692 bp, Homo sapiens
  misc_feature: GZ8MTXP01CF6QI.38.1.A01.1.454.CMB.2.raw
  modified_base (233)..(233): a, c, t, g, unknown or other
  misc_feature (233)..(233): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctcctgcgagggccagtcagagtnttagaacaactgcctggaccatcaagaactgcaggctcccagacctcctcatctatgatcgcactaccccgaccgagggccctacgttcggtccgtaccccaggccctagggtttccaaggttcggacgtaggggttcggggtactagggggaacctgggtactttacccgaccttccgtcaacccagttaccacggcacgtccgttaggtagttacctaagggtaacgtttatttttcggatttaagttttattagtttcgttacgtaaggtacttaagttagttacgaattccggtaaggttccgggacccctttaccgggactttccccgaaccccggtttcgggggacccgttaaaggggggtacccaaccggggtaaacttcggggaaaacccttaaaagttaaacccggtaacgtttgaacgggtccacgttaccctaacggttaactttccg

SEQ ID NO: 359972 - DNA, 587 bp, Homo sapiens
  misc_feature: GZ8MTXP01E0C0I.38.1.A01.1.454.CMB.2.raw
  modified_base (194)..(194): a, c, t, g, unknown or other
  misc_feature (194)..(194): n is a, c, g, or t
  modified_base (251)..(251): a, c, t, g, unknown or other
  misc_feature (251)..(251): n is a, c, g, or t
  modified_base (260)..(260): a, c, t, g, unknown or other
  misc_feature (260)..(260): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
  modified_base (357)..(357): a, c, t, g, unknown or other
  misc_feature (357)..(357): n is a, c, g, or t
  modified_base (560)..(560): a, c, t, g, unknown or other
  misc_feature (560)..(560): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccacctgtctgtgtctccgagggganagacgccaccctctcctgcagggccagtcagagtgttagtaacactagcctgtaccntcagaaccngccagctccanactcctnatctatgatgacntccgacagggccacgttggtctcccagccgtaggttcagtcgggactaggtcgggtctaggggacnggtatccacttctacaccgtatcgacgccaggccctgacctagttacaggttaaagttcgttttacgactttaaggttttatttaagtttggggtcgaaaggttcctaaggttactggattacgaggttccgccttaccgactcgtaacccggttcggaccggaaggggttaccaccggtattacggacttaaacggtaacgngtcggtcggacttcgaaccgaacctcg

SEQ ID NO: 359973 - DNA, 575 bp, Homo sapiens
  misc_feature: GZ8MTXP01A98QZ.38.1.A01.1.454.CMB.2.raw
  modified_base (193)..(193): a, c, t, g, unknown or other
  misc_feature (193)..(193): n is a, c, g, or t
  modified_base (284)..(284): a, c, t, g, unknown or other
  misc_feature (284)..(284): n is a, c, g, or t
  modified_base (450)..(450): a, c, t, g, unknown or other
  misc_feature (450)..(450): n is a, c, g, or t
  modified_base (471)..(471): a, c, t, g, unknown or other
  misc_feature (471)..(471): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtatctccgagggganagacgcccaccctctcctgcagggccagtcagagtgttagaacaacctgcctggtaccatcagaacctggccaggcctccagtacctcctnatctatgatgcactcccacgagggcctacgtggtcgtccccaggtccaggttcaggtcggacgtagggtcggggtcgtgggggaaacacggtcgttccaaccgttctaccaaccctagtccaacgccacgtcctgctagtctaggaagtttatttcgattagtttnttacttgtacgagtctagttntagtactcgtaggtccgtcctccgattccgtaccgtccggcgaaggggtaccacggacgtaaggaacttaagttaacgaactggtcgactgacctcgttgttcc

SEQ ID NO: 359974 - DNA, 563 bp, Homo sapiens
  misc_feature: GZ8MTXP01C7C4D.38.1.A01.1.454.CMB.2.raw
  modified_base (192)..(192): a, c, t, g, unknown or other
  misc_feature (192)..(192): n is a, c, g, or t
  modified_base (208)..(208): a, c, t, g, unknown or other
  misc_feature (208)..(208): n is a, c, g, or t
  modified_base (254)..(254): a, c, t, g, unknown or other
  misc_feature (254)..(254): n is a, c, g, or t
  modified_base (273)..(273): a, c, t, g, unknown or other
  misc_feature (273)..(273): n is a, c, g, or t
  modified_base (387)..(387): a, c, t, g, unknown or other
  misc_feature (387)..(387): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (413)..(413): a, c, t, g, unknown or other
  misc_feature (413)..(413): n is a, c, g, or t
  modified_base (448)..(448): a, c, t, g, unknown or other
  misc_feature (448)..(448): n is a, c, g, or t
  modified_base (558)..(558): a, c, t, g, unknown or other
  misc_feature (558)..(558): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccacctgtctgtgtctccgagggganagacgccacctctccngcagggcagtcagagtgttagaacacctgcctgtaccatcagaacnggacagctaccagcctctnatctatgatcgctactccccgaaccgacgggccctacgtgggttccgtccccagccctaggttcagggttcggcgtaggtggggtcaggggaacagtaacgttcactctacacntcacgcngtcngcagtctagacgttntttgacttagtttattattcgtacgagtctaagtntgatcgaggtcggtccctaccggtactccgtccggttcgggacccggttaaggggaccacggtacgacggaaacttagttaaaacgcgtgtcggcaggttacctaacttnttccg

SEQ ID NO: 359975 - DNA, 566 bp, Homo sapiens
  misc_feature: GZ8MTXP01EL1EI.38.1.A01.1.454.CMB.2.raw
  modified_base (197)..(197): a, c, t, g, unknown or other
  misc_feature (197)..(197): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (280)..(281): a, c, t, g, unknown or other
  misc_feature (280)..(281): n is a, c, g, or t
  modified_base (286)..(286): a, c, t, g, unknown or other
  misc_feature (286)..(286): n is a, c, g, or t
  modified_base (378)..(378): a, c, t, g, unknown or other
  misc_feature (378)..(378): n is a, c, g, or t
  modified_base (419)..(419): a, c, t, g, unknown or other
  misc_feature (419)..(419): n is a, c, g, or t
  modified_base (442)..(442): a, c, t, g, unknown or other
  misc_feature (442)..(442): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagcccacctgtctgtgtcctccgagggganagacgccctaccctctcctgcagggccagtcagagtgttaagtaacactgcctgtaccatcagaacctgcagcnccanactcnntctangatgcactccacgagggcctacgtggtcgtcccagtccgaggttcaggtcggcaggtcggtctaagggactggtacttccactctaccaacntcagtcacgctgactagtctagtaatcttagcttaagtttntattcgggatagtacagttaacngtactacgtaggtcctcctaccgctcccggtaaccgttcggacggaaacgggccaaccggtaacgttaaggaaaccttaaaacggtaaccgtagttcggaacggtcttacggaaccttaacgtg

SEQ ID NO: 359976 - DNA, 542 bp, Homo sapiens
  misc_feature: GZ8MTXP01BGQPV.38.1.A01.1.454.CMB.2.raw
  modified_base (193)..(193): a, c, t, g, unknown or other
  misc_feature (193)..(193): n is a, c, g, or t
  modified_base (371)..(371): a, c, t, g, unknown or other
  misc_feature (371)..(371): n is a, c, g, or t
  modified_base (400)..(400): a, c, t, g, unknown or other
  misc_feature (400)..(400): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagtaacaacctgcctggtaccatcagaacctggccaggcctcccagacctcctcatctatgatgcatcccacgagggcccagtcggtcgtccccagcctaggttcaggtcgcaggtgggtctgggaacagtcgttcactcncaccatcagcagcctgcagtctagtaatntttgcttagtttatattcgtgagtcgtagtatgatcgagtcggcctccgtatcccgaccgttcgggaccgttagggggaccacggtactacgggaaaccaagttaaacgaacgtggtcggctcggacctaacgttaagtccg

SEQ ID NO: 359977 - DNA, 632 bp, Homo sapiens
  misc_feature: GZ8MTXP01BS4IF.38.1.A01.1.454.CMB.2.raw
  modified_base (260)..(260): a, c, t, g, unknown or other
  misc_feature (260)..(260): n is a, c, g, or t
  modified_base (340)..(340): a, c, t, g, unknown or other
  misc_feature (340)..(340): n is a, c, g, or t
  modified_base (480)..(480): a, c, t, g, unknown or other
  misc_feature (480)..(480): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagcccacctgtctgtgtctccgaggggagagacgcccaccctctcctgcagggccagtcagagtgtagaacactgcctagtaccatcagaacngcagctccagactcctcatctatgatgcactcccacgacgggcctacgtggtcgtcccacgccgtaggttcgaggtcggntagggtggtccggtagggactggtacgttaccacgttcctaccaacgtctaccgagctacgctcggactacggttacgtaggtaagttatttttcggactttaaggttttatttagttcgggtactaggtactagttacnggtactaccggtacggttcggtccccttacgtccgttacccgtaaccccggttcggggacccgggaaacggggaccctaaacggacggttaacgggaacttaaaacgtaaaccgcggtcgtacgggacttaccggaaccttaacgttaaccg

SEQ ID NO: 359978 - DNA, 537 bp, Homo sapiens
  misc_feature: GZ8MTXP01A2Y2E.38.1.A01.1.454.CMB.2.raw
  modified_base (193)..(193): a, c, t, g, unknown or other
  misc_feature (193)..(193): n is a, c, g, or t
  modified_base (283)..(283): a, c, t, g, unknown or other
  misc_feature (283)..(283): n is a, c, g, or t
  modified_base (533)..(533): a, c, t, g, unknown or other
  misc_feature (533)..(533): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagtaacactagcctggtaccatcagaacctggccaggcctcccagacctcctnatctatgatgcatcccacgagggcctacgtcggtctccccagcccgtaggttcaggtcggcgtaggtcggggtctaggggaacaggtctttcaccttctaccaccagtcagcagcctgcagtctagtagttatttgacttagtttattattgtcagtctagtatgatcgagtcgcctcgactcgtccgttcggcgaggggaccaggacgtgaaacgaattaaacggaactggtcgctgacctaaccgttnttcg

SEQ ID NO: 359979 - DNA, 526 bp, Homo sapiens
  misc_feature: GZ8MTXP01EBSPK.38.1.A01.1.454.CMB.2.raw
  modified_base (285)..(285): a, c, t, g, unknown or other
  misc_feature (285)..(285): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcagggccagtcagagtgttagtaacaacctagcctggtaccatcagaaacctggccaggctcccagacctcctnatctatgatgcatcccacgaggccagtggtctcccagccaggttcaggtcggcaggtggtctgggaacagtgttcactctacacatcagcagcctgcagtctagtagtatttgcttagtttattattgtactagtctaagtatgatcgagtcgcctcgattccgaccgttcggccgttaggggacacggacgtagggaacttaaagttaaaccgaagtggtcgctggacaaccgttgttcc

SEQ ID NO: 359980 - DNA, 664 bp, Homo sapiens
  misc_feature: GZ8MTXP01DVOYH.38.1.A01.1.454.CMB.2.raw
  modified_base (193)..(193): a, c, t, g, unknown or other
  misc_feature (193)..(193): n is a, c, g, or t
  modified_base (490)..(490): a, c, t, g, unknown or other
  misc_feature (490)..(490): n is a, c, g, or t
  modified_base (664)..(664): a, c, t, g, unknown or other
  misc_feature (664)..(664): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctccagaaatcactggagaaatcgtgatgacgcagtctccagccacctgtctgtgtctccgagggganagacgccaccctctcctgcgagggccagtcagagtgttaacgtaacaaccgtagccgtaggtaccatacaagaaaccctggaccaggcctcccgaagtacctcctacatctatgatcgacctacgtcccaaccgacggggtccctacgttcggggtcctacccccgaaggtccccgtaaggggtttccaaggggttcgggacgtaggggttcggggtcgtaacgggggaactaaggtacgtttccaacctcctaccacatcgagacacgtcctgacgtaggttacctaggtaaattnttttagactttaaggtttacttagttgggtacaggtctagtatgacttgaacggttcggacccttccgaactcccggtaaccgttccggaccgggtaagggaaccctacggaacgttacggaaaacttaaacgtaaaccggagttggcgggtacacgtaaccgttaacccgttn

SEQ ID NO: 359981 - DNA, 568 bp, Homo sapiens
  misc_feature: GZ8MTXP01ATWYU.38.1.A01.1.454.CMB.2.raw
  modified_base (197)..(197): a, c, t, g, unknown or other
  misc_feature (197)..(197): n is a, c, g, or t
  modified_base (432)..(432): a, c, t, g, unknown or other
  misc_feature (432)..(432): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgcccaccctctcctgcagggccagtcagagtgttagtaacaacctgcctggaccatcagaacctggcaggctcccagacctcctcatctatgatgccatcccacgaggggccctacgtggtcgtccccagtcccgaggtttccaggttcggacgagggttcggggtctaagggggactaaggtacgtttcaaccttctccaaccatcagcagcctgctagtctagtaattntttgcttaagtttattacgtggttacagctagtatgatcgaagttcggcctcgattcgccgttcgggccgtaggggaccaggtacgttaggaacaaacggttaaacgacgttggtcggcttacggccttaaccgtg

SEQ ID NO: 359982 - DNA, 518 bp, Homo sapiens
  misc_feature: GZ8MTXP01DXQ46.38.1.A01.1.454.CMB.2.raw
  modified_base (193)..(193): a, c, t, g, unknown or other
  misc_feature (193)..(193): n is a, c, g, or t
  modified_base (205)..(205): a, c, t, g, unknown or other
  misc_feature (205)..(205): n is a, c, g, or t
  modified_base (280)..(280): a, c, t, g, unknown or other
  misc_feature (280)..(280): n is a, c, g, or t
  modified_base (313)..(313): a, c, t, g, unknown or other
  misc_feature (313)..(313): n is a, c, g, or t
  modified_base (357)..(357): a, c, t, g, unknown or other
  misc_feature (357)..(357): n is a, c, g, or t
  modified_base (502)..(502): a, c, t, g, unknown or other
  misc_feature (502)..(502): n is a, c, g, or t
  modified_base (515)..(515): a, c, t, g, unknown or other
  misc_feature (515)..(515): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctntcctgcagggccagtcagtagtgttagaacaactagcctggtaccatcagaacctggccaggctccagactcctnatctatgatgcatcccacgaggccacgtggtcnccagcctaggtcaggtcgcaggtggctgggaacagtgtcactcncacatcagcagcctgcagtctagtagtatttgacttagtttatattgctagactaatagtgaatcgagttcggccttcggacttccaccggttcgacgaggggtaccacgtacgtggaacttaagttaaacgaacgttgcgtcgngacctaaccgttntcg

SEQ ID NO: 359983 - DNA, 638 bp, Homo sapiens
  misc_feature: GZ8MTXP01A2J8Z.38.1.A01.1.454.CMB.2.raw
  modified_base (196)..(196): a, c, t, g, unknown or other
  misc_feature (196)..(196): n is a, c, g, or t
  modified_base (270)..(270): a, c, t, g, unknown or other
  misc_feature (270)..(270): n is a, c, g, or t
  modified_base (293)..(293): a, c, t, g, unknown or other
  misc_feature (293)..(293): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccacctctcctgcgagggccagtcagtagtgttaagtaacaacctagcctaggtaccatcaagaaccnggccaggcctacccagactcctnatctatgatcgccactacccgaccgaggcccagtcggtccgacccagccgtaggttcgacggtcggacgtagggtcggggtcgtaaggggacctggtacgttaccaaccgttccacacccatacacgctacgccgtagacctaggttactaggtaattcgttttacggactttaaggttttaactttagttcgtacgtaggtactaaggttatgtactacgtacggtccgtaccctacgtacctccgtaaccggttcgggacggtaacgggacctaacggtaacgttacgggaaacttaaaaccggtaacggtcgtcggtcgggaccttacgaaccttaacgtcg

SEQ ID NO: 359984 - DNA, 671 bp, Homo sapiens
  misc_feature: GZ8MTXP01BA3HK.38.1.A01.1.454.CMB.2.raw
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctcctgcagggccagtcagagtagtagtaacaactagcctgaccatcagaactggaccagctccagacctcncatctangatgacatcccaccgaggcccacgtcgggtcgtacccgagtccgtaggttacgaggtccggctagggttcggggtcgtacggggaactacggtcggttcccaacccgttccgtaccaacccgtagttccgaacgtaccacggtccctagggacctacggttaccgtaaggtaaacgttttgtttttacgacgtttaagttttattagtttcgtacgtagtacgtagttagtcgtagtccgaggttccggtcccttaccgacgttacccgtacccgggttaacggacccgggaacggggacccttacgggaacgttaacggaaacgttaaacggttaaaaccggtaacgtttgggaaccggtcgtacgacctaaccgttgtttcccg

SEQ ID NO: 359985 - DNA, 716 bp, Homo sapiens
  misc_feature: GZ8MTXP01B0K1D.38.1.A01.1.454.CMB.2.raw
  modified_base (196)..(196): a, c, t, g, unknown or other
  misc_feature (196)..(196): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcagggccagtcagagtgttaagtaacacctagcctggtaccatcagaacctggccaggcctcccagacctcctcatctaatgatcgcatccccaacgacggggcccctacgttggggtcctacccccgaggtcccgtagggtttccagggttcggcgtaggggttcgggggtctaagggggaacctaagggtacgtttcccaaccttcctaccgaacctatccgaggccacggtcccgtagaccgtaggttaccgtaggtaaagtgttggtcgggtaccgttaagttttaactttaccggtaggtttacaacgtactaaatttaagtttagttacgggttacgtcccggttcggtccgtttaccgttaccgggttttaacgggggaccgggttaaacgggggtaacccgttaaagggggttagggaacggttacgttaccggaaacgggtccggtaaacggttcgggtcgggtaccttccgggtaacccttaaccgtttcg

SEQ ID NO: 359986 - DNA, 576 bp, Homo sapiens
  misc_feature: GZ8MTXP01ETB6O.38.1.A01.1.454.CMB.2.raw
  modified_base (195)..(195): a, c, t, g, unknown or other
  misc_feature (195)..(195): n is a, c, g, or t
  modified_base (230)..(230): a, c, t, g, unknown or other
  misc_feature (230)..(230): n is a, c, g, or t
  modified_base (251)..(251): a, c, t, g, unknown or other
  misc_feature (251)..(251): n is a, c, g, or t
  modified_base (276)..(276): a, c, t, g, unknown or other
  misc_feature (276)..(276): n is a, c, g, or t
  modified_base (385)..(385): a, c, t, g, unknown or other
  misc_feature (385)..(385): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccacctgtctgtgtctccgagggganagacgcccacctctcctgcagggccagtcagagtntagtaacacctgcctgtaccntcagaactggcagctccagctcctnatctatgatgacactcccacgagggtccacgtggtcgacccaggccctaggttccaggtcggactagggtcgggtctaaggggactaaggtgttccactctcaaccgtntcagcacgctaggatctaggattatttgacttagtttatattgtacagtctaagtactgacgtcgacgttcgggcccttaccggaattcccggtaccgttcgggaccgttaacgggggacacggtaaccgttaagggaaacaaacgttaaacgtaacggtgtaacggactcggacctaacgttcgttaacg

SEQ ID NO: 359987 - DNA, 703 bp, Homo sapiens
  misc_feature: GZ8MTXP01EY4E7.38.1.A01.1.454.CMB.2.raw
  modified_base (196)..(196): a, c, t, g, unknown or other
  misc_feature (196)..(196): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagcccacctgtctgtgtcctcgagggganagacgcccaccctctcctgcgacgggccagtcagtagttagttaacgtaactaacctagcctaggtaacccatacgaagaaaccgtggaccaggtccctacccgagtacctcctactactctaagtgaactcgaccaacgtccccgaaccgacggggtccctaacggttcggtaccgtaccccacggtacccgtaggttccgaaggtcgggacgtaggggttcggggtacgtaacggggaactaagggtactttaccaccttccctaccaacgtactaccgacgccacggtcccgtagaccgtaggtttaccaagttaagttagttttacggactttaaacggttttacttccgttaaggggtaacttaacgaacttaaagttcgtacgttaacgttaccgtccgggtacccgtacgggttaccggtcgaccgtaagggtcggggaccgagggttacgaaacgtaacaaacggttgttggtgctcggaccaccgttattcgttgtcc

SEQ ID NO: 359988 - DNA, 602 bp, Homo sapiens
  misc_feature: GZ8MTXP01DOZH7.38.1.A01.1.454.CMB.2.raw
  modified_base (196)..(196): a, c, t, g, unknown or other
  misc_feature (196)..(196): n is a, c, g, or t
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcagggccagtcagtagtgttaagaaccactagcctggtaccatcaagaactgcagctccanactcnatctatgatcgacactacccaccgacgggcctacgttggtccgtacccgagccgtaggttccgaaggtcgggacgtagggttcgggtcggtaacggggaactggtacgtttcccaaccttccaccaactgtacagtcacgtctaggctagtcgtagtaagttgtttgactttagttaattgttggtacagtactagttatgtatcgtacggtcgtacccgttacacgttcccgtaacggtcggaccgggagggaccaacggtacgttaacgggaacttaaaacgtaaccgtagtcggtacggacttcgaaccttcgttaac

SEQ ID NO: 359989 - DNA, 590 bp, Homo sapiens
  misc_feature: GZ8MTXP01A3E39.38.1.A01.1.454.CMB.2.raw
  modified_base (195)..(195): a, c, t, g, unknown or other
  misc_feature (195)..(195): n is a, c, g, or t
  modified_base (213)..(213): a, c, t, g, unknown or other
  misc_feature (213)..(213): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (380)..(380): a, c, t, g, unknown or other
  misc_feature (380)..(380): n is a, c, g, or t
  modified_base (435)..(435): a, c, t, g, unknown or other
  misc_feature (435)..(435): n is a, c, g, or t
  modified_base (576)..(576): a, c, t, g, unknown or other
  misc_feature (576)..(576): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctccngcagggccagtcagagtgtagtaacacctagcctagtaccatcagaacctgaccaggctcccagacctcctnatctangatgcaactcccgaacgacgggcctacgtggtcgtccccagccgtaggggtttccaaggttggacgtagggttcgggtcgtaagggacnggtagttccactctacacatccagcacgtcctggacctagtcctagtaaagtttntttacgacgtttagtttattagttcggtacaggtactagttatcgtatacggtagtccggtaccctaccgtactcccgtaaccggttccgggaccggacgggaccacgtacgaagaaccaaacgtaacgacgtcgacggcncgtaacttaacgtc

SEQ ID NO: 359990 - DNA, 656 bp, Homo sapiens
  misc_feature: GZ8MTXP01BH8Q1.38.1.A01.1.454.CMB.2.raw
  modified_base (197)..(197): a, c, t, g, unknown or other
  misc_feature (197)..(197): n is a, c, g, or t
  modified_base (487)..(487): a, c, t, g, unknown or other
  misc_feature (487)..(487): n is a, c, g, or t
  modified_base (522)..(522): a, c, t, g, unknown or other
  misc_feature (522)..(522): n is a, c, g, or t
  modified_base (531)..(531): a, c, t, g, unknown or other
  misc_feature (531)..(531): n is a, c, g, or t
  modified_base (623)..(623): a, c, t, g, unknown or other
  misc_feature (623)..(623): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgccaccctctcctgcagggccagtcagtagtgttaagtaacaacctagcctaggtaccatcaagaaacctggccaggcctcccgagacctcctcatctatgaatcgaccactccccgaaccgacggggccctacggttgggtccgtaccccaaggtcccgtaagggtttccagggttcgggacgtaggggttcggggtccgtaagggggaacctaagggtacgtttaccacttcctaaccacctatccaaggccacggccctggacctaggttactagtaaagttnttttacggattaagttttattacgtggtacaggtntaaggttancgtaatcgaggttcgaccttcggactccgtaacccgttcgggacggaacggggaccaacggtacgttacggaaacttaaaagtaaaaccggngttgggtaccggcttacgaacccgttaacgttg

SEQ ID NO: 359991 - DNA, 743 bp, Homo sapiens
  misc_feature: GZ8MTXP01DGGBB.38.1.A01.1.454.CMB.2.raw
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggggagagacgcccaccctctcctgcagggccagtcagagtgttagaacaactagcctggtaccatcaagaaacctggccaggcctcccagacctcctacatctatgatgcactcccaccgacgggccctacgttggtccgtacccagtcccgtaggttccaggttggacgtagggtcgggggtcgtaagggggaactcggtacgtttcccaaccttcctaccaacccgtataccgaacgtccgaacgtccccgttagacctaaggttccgttaaggtaaagtttacgtttttagacgtttaaggtttttaactttaggtttcggggtaaccgtaagggttactaaggtttaatcggtaacgttaccggtaacggggttcccggtccccgtttacccgtaacgttccccgggttaaccccggttacgggggaaccccgggtaaacgggggaaccctaaacgggtaacggttacggggaaaacccttaaaaacggttaaaaccgggtaccgtttgggaacgggcccttacgggtaaccccttaaccggtttcg

SEQ ID NO: 359992 - DNA, 713 bp, Homo sapiens
  misc_feature: GZ8MTXP01C6HO3.38.1.A01.1.454.CMB.2.raw
  modified_base (658)..(658): a, c, t, g, unknown or other
  misc_feature (658)..(658): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccacctgtctgtgtctccgaggggagagacgccaccctctcctgcagggccagtcaagtagttagttaacgtaacaaccgtagcctacggtaaccatacaagtaaacccgtggacccaggacctcccgaagtacctccctactattctaatgaatgacctaacctaccccgaaccggtacgggtaccctaacccggttcggtaccgtacccccgaacggtccccgtaaggggtttaccgagggttccgggacgtaggggttcggggttcccggtaaaggggaacctaaggttacgtttacccaccgttcctaccacgtagtccagtcacgcctagccgtagtacgtaggttaacttagttttacgatttaagtttttaattatttacggggtacagggtactaagttagtacgtaagttcggtaacggtccgtacccgttaccgtacttccggttaaacccggtcgggaaaccgggacgggttaaaccnggtaacccgaagttaaacgaaataaacggacgtggtacgcttacgcaacccgttg

SEQ ID NO: 359993 - DNA, 641 bp, Homo sapiens
  misc_feature: GZ8MTXP01EM9O5.38.1.A01.1.454.CMB.2.raw
  modified_base (247)..(247): a, c, t, g, unknown or other
  misc_feature (247)..(247): n is a, c, g, or t
  modified_base (381)..(381): a, c, t, g, unknown or other
  misc_feature (381)..(381): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggcctcccagaaatcactggagaaatcgtgatgacgcagtctccagccaccctgtctgtgtctccgaggggagagacgcccacccctctcctgcgagggccagtcagagtgttaagaacaactncctgtaccatcaagaactggcaggctccagacctcctcatctatgatcgacactcccaccgacgggccctacgttggtccgtcccgagcccgtagggttaccgaggtggacgtaggtcggggtctaggggaacnggtacgttcacttccacacctatacagcacgtcctgacctagtactagaaagttcgttttagactttaaggttttatttagttacggggtctaaggtactaaggttattaggacttacggtacggttccggtcccttaccggaacttcccggtaaccggtttccgggacccgggaaacggggttaccaaacggtaacgttacggaaaacttaaaacgtaaaccggtagtcggttacggacttacgtaaccaacgttaacg

SEQ ID NO: 359994 - DNA, 624 bp, Homo sapiens
  misc_feature: GZ8MTXP01EOWSQ.38.1.A01.1.454.CMB.2.raw
  modified_base (214)..(214): a, c, t, g, unknown or other
  misc_feature (214)..(214): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctccngcagggccagtcagagtgttaagtaacaacctagcctggtaccatcaagaacctggccaggcctcccagacctcctacatctatgatcgcactcccgacgacgggcctacgttggtccgtcccaggcccgtaggttcaggtcggcgtaggggttcggggtcgtaggggaacctggtacgttacccacttcctaccaacccgatcccgagctacgcctcgtcagttacgtaggtaagttacttttggaactttagttttaattagtttcggtacgtaagtctaaggttatgtaagtcgtagtcggtacccgtcgtaccttccgtaacccggttcgggacggacgggggttaccacggtaacgaggaaaccaaaggtaacgtagtcggtacgcgttacgtccttaacgtaac

SEQ ID NO: 359995 - DNA, 655 bp, Homo sapiens
  misc_feature: GZ8MTXP01CN7S8.38.1.A01.1.454.CMB.2.raw
  modified_base (199)..(199): a, c, t, g, unknown or other
  misc_feature (199)..(199): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggaagaaatcgtgatgacgcagtctccagcccaccctgtctgtgtctccgaggggganagacgcccaccctctcctgcagggccagtcagtagtgttaagtaacaacctgcctggtaccatcagaaacctggcccaggcctacccagtacctcctacatctatgatcgacatccccacgacgggccctacgttggtccgtccccagcccgtaggtttcacggttcgggacgtaggggttcggggtccgtagggggaacctaaggtacgtttccacttctacaacctatcagtcacgctgcctagtctagtaagttcttttagacttaagtttatttagtttggtactaaggtctaaggttactggtacttcgtacggtccggtaccctccggtacttcccgtaaccccggtttccgggaccggtaacgggggacctaaccgggtacgttaacgggaaacttaaaacggttaaacgaacgtgggtacggacttacggaaccgttaaccgttaacg

SEQ ID NO: 359996 - DNA, 780 bp, Homo sapiens
  misc_feature: GZ8MTXP01CIWUA.38.1.A01.1.454.CMB.2.raw
  modified_base (192)..(192): a, c, t, g, unknown or other
  misc_feature (192)..(192): n is a, c, g, or t
tcagtcgatcacgtcacgaccggtgctcgatttagacgtctcatcagggggggaactgctcagttaggacccagacggaaccatggaagccccagcgcagcttctcttcctcctgatactctggctcccagaaatcactggagaaatcgtgatgacgcagtctccagccacctgtctgtgtctcgagggganagagcccacctctcctgcacgggccagtcagagtgttaagtaacaacctagcctaggaccagtacagaaacctggaccacggctccagtactcctcactctaatgatcgcactacccaaccgacggggtcctacgtcgggtcctacccgacgtcccgtaaggttcgaggtccgggtaccgtaggggtttcggggtacgtacgggggtaaacctaagggttaacgtttccgaaacccgttcgttacccaaacccctagtaccgtaaacgggcccaacggtcccttacgggccctaggttaaccgtaggggttaaaatttaaccgtttttggaaccggtttaaagtttttaacgttttactttaggtttacccgggaaacggttacgtttaaacgggttttaaacgtacggttaaccgttacgggttacggttacccggtacccgttaccggtacttacccggttacccggtaacccggggaccggttaacggggtaaccaaaccggtaaaccggtaacggttaaaaccgttaaaacgttaaaccggtgttacggtaaccggtacgtaccgaccctaaccgttcgttccg

SEQ ID NO: 359997 - DNA, 659 bp, Homo sapiens
  misc_feature: GZ8MTXP01EQEL9.38.1.A01.1.454.CMB.2.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (393)..(393): a, c, t, g, unknown or other
  misc_feature (393)..(393): n is a, c, g, or t
  modified_base (421)..(421): a, c, t, g, unknown or other
  misc_feature (421)..(421): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggcctcccagaaatcactggagaaatcgtgatgacgcagtctccagcccaccctgtctgtgtctccgagggganacgaacccncctctcctgcagggccagtcagagtgttaagtaacaacctgcctaggtaccatcaagaacctggaccaggcctcccagtcctcctcatctatgatcgactactcccacgacgggcctacgtcggtcgtcccagcctaggttcaggtcggctaggtggtcgtgggaacagtcgttcactctcacctntcgagcagtcctgctaggtctagatttntttcgattagttttattagttacgtacgagttacgtagttacgtagtaacgttcggtaaggtttcccgggtaccccttacccgggtattacccccggtaaccgggtttaaccccggggaaccggttaaacggggggttaacccaaacgggttaaccggttaacggaaaacccgtttaaaacgttaaacccggtccggtggtaacgggcccgttagaccctaacccgtttaacgttccg

SEQ ID NO: 359998 - DNA, 685 bp, Homo sapiens
  misc_feature: GZ8MTXP01DZ73R.38.1.A01.1.454.CMB.2.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (269)..(269): a, c, t, g, unknown or other
  misc_feature (269)..(269): n is a, c, g, or t
  modified_base (294)..(294): a, c, t, g, unknown or other
  misc_feature (294)..(294): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggaagaaatcgtgatgacgcagtctccacgccaccctgtctgtgtctcgagggganagacnccacctctcctgcgagggccagtcagtagtagttaanaaccaacgtgcctagtaccatcaagaaccnggacaggccacccagtacctcctanagtactatgactcgacacctacccgaacggacggtacccgtacgttcgggtaccacccgtagaccggttaggtacgtaggtcggtacggtggggttcggggtacggtaacgggactaaggtacgttaccacctctaccacgtactcgaacgccgtacgtcgtagaccgttaaggttaacgtagttaaacgtttacgttttacggatttaaaggtttttaattggttaacggttacgtaagttagtaaggtagtacgttaccgtagtaacgggttccggtaccctttacaaccttcccggtaacggtcgggacggaacggggttaccaaacggtacggttaacggaaacaaaacggttaaccgaaggttggcgacacggtaacaacgtttcg

SEQ ID NO: 359999 - DNA, 655 bp, Homo sapiens
  misc_feature: GZ8MTXP01BX4UL.38.1.A01.1.454.CMB.2.raw
  modified_base (296)..(296): a, c, t, g, unknown or other
  misc_feature (296)..(296): n is a, c, g, or t
  modified_base (440)..(440): a, c, t, g, unknown or other
  misc_feature (440)..(440): n is a, c, g, or t
  modified_base (470)..(470): a, c, t, g, unknown or other
  misc_feature (470)..(470): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccaagaaatcactggagaaatcgtgatgacgcagtctccagcccaccctgtctgtgtctccgaggggagagacgcccaccctctcctgcagggccagtcagagtagttaagaacaactgctaggtaccatcgagaaccgtggccacggcctacccgacgtactcctanatctagtgtatgcacctacccgaacgacggggcctacggtcggtccgtacccgacgtcccgtaggtttcgacggtcggtacgtaggggtcgggtcgtaacgggggaactgggtacgttccaaccttctaccaaccatcgacgcncgactgacgtacggttactagtaaagtttntttagtactttaagttttattagttcgggtacgtagtacgtagttattagtacgttacgtacggtccgtccctaccgtaccgtcccgtaaccggtcggacggacggaaccgtacggtaacgttaacggaaacttaaaccgtaacgtacggtaacggtacggtcgttactaaccgttaacgtaacg

SEQ ID NO: 360000 - DNA, 619 bp, Homo sapiens
  misc_feature: GZ8MTXP01AEPKU.38.1.A01.1.454.CMB.2.raw
  modified_base (196)..(196): a, c, t, g, unknown or other
  misc_feature (196)..(196): n is a, c, g, or t
  modified_base (295)..(295): a, c, t, g, unknown or other
  misc_feature (295)..(295): n is a, c, g, or t
  modified_base (302)..(303): a, c, t, g, unknown or other
  misc_feature (302)..(303): n is a, c, g, or t
  modified_base (462)..(462): a, c, t, g, unknown or other
  misc_feature (462)..(462): n is a, c, g, or t
  modified_base (477)..(477): a, c, t, g, unknown or other
  misc_feature (477)..(477): n is a, c, g, or t
  modified_base (504)..(504): a, c, t, g, unknown or other
  misc_feature (504)..(504): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgcccaccctctcctggcacgggccagtcaaggtagttagttaagtaaccaacctagcctacggtaccatcacgaacctggccagcctccagctcncatctannatcgacactcccgaccgacgggcctacgtcggtccgtacccgacggtccgtaggttcgacggtggtcgtaggggtcggggtcgtaaggggaactaaggtacgttccacttcccacaacactcaacgcgtacgccgtacgaccggtatcgtagtaagttntttgactttaagttntttaattcgggtataggtactaaggtnttggacttacgtacggtcggtacccctagtacctaccgtccggtcgcgggaacgggactaacgacgttacggaaacttaaacgtaacgtacgttggcggacactaacgaacgttc

SEQ ID NO: 360001 - DNA, 685 bp, Homo sapiens
  misc_feature: GZ8MTXP01C56WM.38.1.A01.1.454.CMB.2.raw
  modified_base (197)..(197): a, c, t, g, unknown or other
  misc_feature (197)..(197): n is a, c, g, or t
  modified_base (423)..(423): a, c, t, g, unknown or other
  misc_feature (423)..(423): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggganagacgccaccctctcctgcgagggccagtcagagtgttaagaacactagcctgtaccatcaagaacctggaccaggcctcccagacctcctacattctatgatcgaccactccccaacgacgggcctacggttggtcctacccgagtccccgtagggtttccaggtcgggactaggggtcgggtcgtaaggggaacctaaggtacgtttccactttccgacaaccnttcagcacgtccgtgacttaggtactaggtaaagtttgtttcggaactttaggtttttaaacttgtttacgggggttactaagggttattaaggtttaatggtaaacttcggtaaggtccggtaccccttaccgggacttcccggtaacccggttacgggacccggtaagggggaacccaacgggtaacgttaaacggaaaccttaaagtaaaacccgggtagtttccgggaggtaccttacggaaccgttaaccgttaacg

SEQ ID NO: 360002 - DNA, 725 bp, Homo sapiens
  misc_feature: GZ8MTXP01C4Z80.38.1.A01.1.454.CMB.2.raw
  modified_base (191)..(191): a, c, t, g, unknown or other
  misc_feature (191)..(191): n is a, c, g, or t
  modified_base (281)..(281): a, c, t, g, unknown or other
  misc_feature (281)..(281): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctccagaaatcatggagaaatcgtgatgacgcagtctccagccacctgtctgtgtctcgagggganagacgcccaccctctcctgcgagggccagtcagtagtgttaagaacactgctgaccatcaagaacctgaccaggcctacccagacctctnatctatgatgacactcccgaacgcgggccagttcggtcctaccccaggcccgtaagggttccaagggttcgggacgtaggggttcggggtctaacgggggaactgggtactttccaacttccaccaacctatcccgaagtccacggtccctaggacctaggttacgttaagggtaaatttccgtttttacggaactttaagggttttttaaactttagtttccgggggttaaacgtaaacggtaacgttaaggttaactacggtaacttaccggtaaccgggttcccgtacccgttacccgtaaccgttccccgggttaaacccgggtccggggaaccgggtaaacggggttaaacctaaaccgggtaacggttaaacggaaaaccttaaaacggtaaaccggtacgttcgggtaccgacttaccgtaacccgttaacgttaag

SEQ ID NO: 360003 - DNA, 762 bp, Homo sapiens
  misc_feature: GZ8MTXP01D2XQS.38.1.A01.1.454.CMB.2.raw
  modified_base (196)..(196): a, c, t, g, unknown or other
  misc_feature (196)..(196): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgcccaccctctccgtgcgagggccagtcagtagtagttaacgaacaaccgtagcctaggtaaccatacaacgaaaccgtcggaccgaggcctacccgagtaccctcctactagtctagtgtatcgacctactacccgaccggacgggtaccctacggttcggtccgtacccgagtaccgtaggttacaggttcggacgtagggtcgggtacggtaacgggaactaagggttactttacccacgtttccccaacctaaccggcttaacgacgtacgacgtcccgtaggtaccgtaggttaccgttaaggttaaacgtttagtttttaccgacgttttaaaggtttttaacttacggtttacggtaaccgtaacgggttattaacggttagttacggtaacgtttacggtaaaccgggttccgtacccgggttaccttaaccgttccccggtaacccggtttacccgggacgggtaacgggaacctaaacggtacggttaaacgaaacgttaaaacgttaaccggaagtttcgggcgtacttacgtaacccttaacgtttaacg

SEQ ID NO: 360004 - DNA, 599 bp, Homo sapiens
  misc_feature: GZ8MTXP01CZJP5.38.1.A01.1.454.CMB.2.raw
  modified_base (193)..(193): a, c, t, g, unknown or other
  misc_feature (193)..(193): n is a, c, g, or t
  modified_base (346)..(346): a, c, t, g, unknown or other
  misc_feature (346)..(346): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgccgacgggccagtcagtagttagttaagtaaaccaacctagcctaggtaacccataccaagaaacctggaccaggcctacccagacctcctcatctatgactgctatccccaaccgagggccctacgtgggtcncccgagccgtaggttcaggtcggctaggtcgggtctggggaaacaggtcgttcacctctacacctancagcngcctgctagtctagtaattagtttcgacttagtttacttagtttacgtcgtagtacgtagttagtgtacgtcgtacgttcggtcctaccggtaactcccgtaacccggttccggaccgagggggtaccacggacgtagaacgttaaagaaacgaattaggcggctgacctcttaagttccg

SEQ ID NO: 360005 - DNA, 539 bp, Homo sapiens
  misc_feature: GZ8MTXP01ARXPH.38.1.A01.1.454.CMB.2.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
  modified_base (289)..(289): a, c, t, g, unknown or other
  misc_feature (289)..(289): n is a, c, g, or t
  modified_base (374)..(374): a, c, t, g, unknown or other
  misc_feature (374)..(374): n is a, c, g, or t
  modified_base (432)..(432): a, c, t, g, unknown or other
  misc_feature (432)..(432): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgcccaccctctcctgcagggccagtcagngtgtagtaacacctagcctggtaccatcagaacctggccaggctccagctctcatctangatgcatccacgagggccacgtggtctcccagcctaggttcaggtcggcaggtcgggtcagggactggtattccactctcacctntccagctagtctgtatcgtagtattatttgacttagtttattagttggtactaaggtntaagtatgtagtcgacgttccgtacctcgtactccgtcgtcggacgagggaccacgacgtacgaaacgttaaacgttaaccgtgtggtcgctcgacctaacgttgtc

SEQ ID NO: 360006 - DNA, 557 bp, Homo sapiens
  misc_feature: GZ8MTXP01A3BNI.38.1.A01.1.454.CMB.2.raw
  modified_base (196)..(196): a, c, t, g, unknown or other
  misc_feature (196)..(196): n is a, c, g, or t
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
  modified_base (329)..(329): a, c, t, g, unknown or other
  misc_feature (329)..(329): n is a, c, g, or t
  modified_base (392)..(392): a, c, t, g, unknown or other
  misc_feature (392)..(392): n is a, c, g, or t
  modified_base (541)..(541): a, c, t, g, unknown or other
  misc_feature (541)..(541): n is a, c, g, or t
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (557)..(557): a, c, t, g, unknown or other
  misc_feature (557)..(557): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggganagacgcccaccctctcctgcagggccagtcagagtgttagaacactgcctggtaccatcagaacctggccaggctcccanacctcctcatctangatgacatccccaccgagggcccacgttggtctacccgngccgtaggttcaggttggacgtggtgggtcgaggggactggtcgtttcacttcctcaaccctntacgagcacgcctgccgtagtcgtagtaagttgtttcgactagttttattgttggtctagacgtagtatagtagtcgtagtccggtccttacggacttccgtaacgttccggcggacgggttacacggtacgttaggacaagtaaacgntggtcgnacncgcgtn

SEQ ID NO: 360007 - DNA, 674 bp, Homo sapiens
  misc_feature: GZ8MTXP01A9J2V.38.1.A01.1.454.CMB.2.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgcccaccctctcctgcgacgggccagtcagtagtagttaacgtaacaactgcctaggtaccatacagaacctggaccaggcctcccgagacctcctanattctatgactcgacctacgtacccgaaccgacgggggtcccctacgggttacgggtaccgtaacccgacggtaccccggtagggtttaccgaacgggttcgggacgtaggggttcgggggtacgtaacggggaactaagggtacttccacctcctaccactatccgacgcacggcctgactagttactaggtaacttagtttgactttagtttattgtggttacaggtactagttagtgtacttcggtacggttccggtacccttacggtctccccgtaaacggttccgggaccggtaacggggacaaccggtacgttaacggaacttaaacgtaaacggtcgtaacggtacggtccacgtccttaaccgttcg

SEQ ID NO: 360008 - DNA, 697 bp, Homo sapiens
  misc_feature: GZ8MTXP01B5L40.38.1.A01.1.454.CMB.2.raw
  modified_base (194)..(194): a, c, t, g, unknown or other
  misc_feature (194)..(194): n is a, c, g, or t
tcagtcgatcacgtcacgaccggtgctcgatttagacgtctcatcagggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcagggccagtcagagtgtagtaacactgcctggtaccatcagaacctggccaggcctcccagtcctcctcatctatgatcgacctactaccccgaaccgacgggggccctacggttcgggtaccgtcccccgagtccgtaggttcaggttcggctaggggtcgggtcgtggggaaacagggtcgtttccaaccttcgtacccaccgtatcgacgccacggtccctggaccttaggttaccgttaagggttaagtttacgtttttcgggtactttaaaggttttttatttaagtttcggttacgaggtacgttaaggttattggtaactcggtacgggttcccggccccttaccggtaacctttccccggtacccggttaacccggggccggttaaacgggggtcccaaccggtaacggttacgggaaaaccttaaacgttaaccggaacgttgggtaacgcgtacgacctaaccgttgtttccg

SEQ ID NO: 360009 - DNA, 709 bp, Homo sapiens
  misc_feature: GZ8MTXP01B4J9Z.38.1.A01.1.454.CMB.2.raw
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctcctgcagggccagtcagagtgttagtaacaacctagcctggtaccatcagaacctggccaggctcccagactcctcatctatgatcgccactccccaaccgacgggggccctacgttcggtccgtcccccgaaggtccccgtagggtttccacgggttcgggacgtaggggttcgggggttacctaagggggaacctaagggtacgtttccaccttccctacgacccatccgagcacgcctgcaggttcagtaagttattttgacttagttttatttagtttgggtactaggtacttaaggttataggtacgttacgtaacgggtccggtcccgttacccgggtactttccccggtaacccggtttcccggggacccgggtaacgggggaacccgtaacccgggtaaacggttaacgggaaacccgttaaaacggttaaaacccggtaacggttaagggtacccggtacgttacccggtaaccttaacccggtttaacg

SEQ ID NO: 360010 - DNA, 707 bp, Homo sapiens
  misc_feature: GZ8MTXP01DWN7K.38.1.A01.1.454.CMB.2.raw
  modified_base (192)..(192): a, c, t, g, unknown or other
  misc_feature (192)..(192): n is a, c, g, or t
  modified_base (210)..(210): a, c, t, g, unknown or other
  misc_feature (210)..(210): n is a, c, g, or t
tcagtcgatcacgtcacgaccggtgctcgatttagacgtctcatcagggggggaactgctcagttaggacccagacggaaccatggaagccccagcgcagcttctcttcctcctgatactctggctcccagaaatcactggagaaatcgtgatgacgcagtctccagccacctgtctgtgtctcgagggganagacgcccaccctctccnggcagggccagtcagtagtagttaagaacaactagcctaggtacccatacgaagaaacctggaccaggcctacccagacctcctacatctatgatcgaccactccccgacgtacgggccctacggtcggtacgtccccgaggtcccgtaggttcgaggttcggccgtagggttcggggtacctagggggaaacctagggtaacggtttaccaaccgttcctaccaacctagtaccgacggaccacggtccctagactacggttactaaggtaaagttattttcggatttaaggttttaattagtttacggtactaagggtacttaaggttaagtggtaacttccggtaaggttcccgggacccttaccggtaacgttccccgtaacccggttaacgggaccggaacgggggaccttaaacggtaacggttaacggaaaacgttaaacgttaaaccggtaacgtgtaacgggtctaccggactaacccttggtttccg

SEQ ID NO: 360011 - DNA, 696 bp, Homo sapiens
  misc_feature: GZ8MTXP01DRMJ8.38.1.A01.1.454.CMB.2.raw
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtcctccgaggggagagacgccaccctctcctgcagggccagtcagtagtgttaagaacactagcctagtaccatcaagaacctggaccaggcctcccagacctcctacagttctatgactcgcaacctcccaccgacggggcccctacgtcggtccgtaccccaggacccgtggtttaccgaggttcgggactagggggttcggggttacgaacggggtaaccaaggttacgtttcccacctacgtcccaaccgtatcgacgactacggcccgtagacctacgtacgttagtaaagtttattttcgtatttaaggtttttaattagttttacggggtactaggtactaggttagtaagtctacgtaaggttccgtacccgtacgtaccgttccgtaaccccggttacgggaccggaacgggggttacctaaaccgggtagttaaaccggttaaacgttaaaaacgtaaaccggttaagtcggttaacgcgttacgaacccttaacgtttaaccg

SEQ ID NO: 360012 - DNA, 686 bp, Homo sapiens
  misc_feature: GZ8MTXP01B4MTH.38.1.A01.1.454.CMB.2.raw
  modified_base (197)..(197): a, c, t, g, unknown or other
  misc_feature (197)..(197): n is a, c, g, or t
  modified_base (273)..(273): a, c, t, g, unknown or other
  misc_feature (273)..(273): n is a, c, g, or t
  modified_base (279)..(280): a, c, t, g, unknown or other
  misc_feature (279)..(280): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgcccaccctctcctgcagggccagtcagagtgtaagtaacactgctgacatcagaactgcagctccagctcnatctannatcgcactcccaaccgcggggccctacgttcggtctccccaggcccgtaggttccagggttcggacgtaggggtcggggtcgtaacgggggactaaggggtactttccgaaccttcctaccgaacctagtccacggtccaacggtcccgtgccgtagtaccgtaggtaagtttacttttaggactttaggttttaattaagtttggggtacctaaggtaccttaggtttaacgtgtacgttacgtaacggtccgggtaccccttaccggtacgttccccgttaacccgggttcccgggaccgggtaaacggggaccctaaaccgggtaacgttaaacgggaaacccttaaaaacgttaaaccggacgttcgggtaccggacttaccggaaccttaaccgttaaccg

SEQ ID NO: 360013 - DNA, 628 bp, Homo sapiens
  misc_feature: GZ8MTXP01BO751.38.1.A01.1.454.CMB.2.raw
  modified_base (196)..(196): a, c, t, g, unknown or other
  misc_feature (196)..(196): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgccaccctctcctgcagggccagtcagagtgttaagaacaacctagcctaggtaccatcaagaaacctggccaggcctcccagacctcctcatctatgatcgacactcccacgacgggcctacgtcggtctccccagccctaggttcaggtcggactaggggttcggggtcgtaagggggaacctgggtacgtttccaaccctttcctaccaaccctagtaccacgccacggcccttgcctagttactagtaagttattttcggacttagtttaatttagttcggtataagtctaagttatgtacgtcgtaagggttccgtcccgtaccgacttccgtaaccgttccgggaccggaaggggttaccaacggtacgttacggaacttaaacgtaaacgacgtgtacggcttacgaaccttaacgtaacg

SEQ ID NO: 360014 - DNA, 717 bp, Homo sapiens
  misc_feature: GZ8MTXP01DQ2XH.38.1.A01.1.454.CMB.2.raw
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (284)..(284): a, c, t, g, unknown or other
  misc_feature (284)..(284): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccacctgtctgtntctccgagggganagacgcccaccctctcctgcagggccagtcagagtgttagaacaactagcctggtaccatcaagaactggacaggctcccagactcctnatcatgatgcactaccacgagggccacgtggctacccagtccagggttccaggtcggacgtaggtcggggtctaacgggggactaagggtacgtttacccaccgtttccgaccgaacccgtactaccgacgtacccgaacggttcccgtacggaccgtaacggttaccgttacgggttaaagtttaccgtttttagggaacctttaaaggtttttaaactttaggtttacggttaaccgttaaggaaccgtttaaaggtaccttaagggtaattccggtaagggtttccggtaccccgtttaccggtaacttcccgggtaacccgttccgggaacccgggaaacgggggttaaccaaccgggtaacttacgggaaacccttaaaagttaaaaccggacttggcgggtaccttacgggaacccttccgttaacg

SEQ ID NO: 360015 - DNA, 736 bp, Homo sapiens
  misc_feature: GZ8MTXP01C2NCO.38.1.A01.1.454.CMB.2.raw
  modified_base (196)..(196): a, c, t, g, unknown or other
  misc_feature (196)..(196): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcagggccagtcagagtgtaagtaacactgcctggaccatcagaaacctggaccaggcctcccagtacctcctcaatctatgatcgacactcccaccgacgggccctagtggccgtaccccgagtcccgtaggttcaacggttggacgtagggtcgggggtcctaagggggaacctaagggtacgtttaccgaaccgttcctacccgaaccctataccgaacggtcctaacgggccccttaggacccgtaaggttaccgttaaggggttaaattaacgttttttgggaaacctttaagggtttttaaactttaagtttgggtaccgtaaggtaccttaagggttactaacggggtaattcgtaaacgggttccggtacccttacccggtaacttccccgtaacccggtttccgggacccgggttaaacgggggaccctaaaccgggtaacgttaacgggaaaccttaaaaggttaaaacccggagttcggttacgggcccttaggccccttaaccgttaacg

SEQ ID NO: 360016 - DNA, 670 bp, Homo sapiens
  misc_feature: GZ8MTXP01DCF7S.38.1.A01.1.454.CMB.2.raw
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (655)..(655): a, c, t, g, unknown or other
  misc_feature (655)..(655): n is a, c, g, or t
tcagtcgatcacgtcacgaccggtgctcgatttagacgtctcatcaggggggaggaactgctcagttaggacccagacggaaccatggaagccccagcgcagcttctcttcctcctgatactctggctcccagaaatcactggagaaatcgtgatgacgcagtctccagccacctgtctgtntctccgagggganagacgccaccctctcgtgcgagggccagtcaagtgttagttaacgtaaccaacgtagccttaggtaaccatcgaaacgtaaacccgtcggacccgaacggtccctacccgaacgtacccttcctctaacttctatgactcgaccactcccgaacggacgggcctacgtcggtacctacccgacggtccgaggtttcacgggttcgggagtggggttcggcggtaacgggaactggttactccactccactacatacgacgagacctcgtgaccgttagtacgtagtagtttctttaggattttaagtttattcgttaacggtataggtaacttagttacgtcgtaagtcgttaacggtccggtcccttacgggtaaacctccgggttaaacccgtcgggaccccggttaagggaaccttacggacttaaacggacttaaaacggtcgtacgtgtaccggnttaccgtcaaccttg

SEQ ID NO: 360017 - DNA, 502 bp, Homo sapiens
  misc_feature: GZ8MTXP02G47KH.38.1.A01.1.454.CMB.2.raw
  modified_base (349)..(349): a, c, t, g, unknown or other
  misc_feature (349)..(349): n is a, c, g, or t
  modified_base (412)..(412): a, c, t, g, unknown or other
  misc_feature (412)..(412): n is a, c, g, or t
tcagtcgatcacgtcacgaccggtgctcgatttagacgtctcatcaggggaggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagtaacaacctagcctggtaccatcagaaacctggccaggctcccagacctcctcatctatgatgcatccacagggccactggtcgtcccagccaggttcagtgcagtgggtctgggacngagttcactctcacatcagcagcctgcagtctgaagtatttgactagtttattattgtctagnagtatgatatagtcgtcgtcgtactctaccgtcgcgacggacgacgacgtacgaacgaacgtaaacgaacgtacgtacgcgacgacacac

SEQ ID NO: 360018 - DNA, 481 bp, Homo sapiens
  misc_feature: GZ8MTXP02F8661.38.1.A01.1.454.CMB.2.raw
  modified_base (193)..(193): a, c, t, g, unknown or other
  misc_feature (193)..(193): n is a, c, g, or t
  modified_base (386)..(386): a, c, t, g, unknown or other
  misc_feature (386)..(386): n is a, c, g, or t
tcagtcgatcacgtcacgaccggtgctcgatttagacgtctcatcaggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagaacaacctagcctggtaccatcagaaacctggccaggctcccagactcctcatcatgatgcatcccacagggccactggtgtcccagccaggttcagtggcagtgggtctggggacagagttcactctcaccatcagcagcctgcagtctgaagntttgctagtttatattgtcagcagtatgatcagtgcctcgatcacttcggcacgggacacgactaggacaataaacgactgtacggctgacacta

SEQ ID NO: 360019 - DNA, 518 bp, Homo sapiens
  misc_feature: GZ8MTXP02GB165.38.1.A01.1.454.CMB.2.raw
  modified_base (283)..(283): a, c, t, g, unknown or other
  misc_feature (283)..(283): n is a, c, g, or t
  modified_base (356)..(356): a, c, t, g, unknown or other
  misc_feature (356)..(356): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagaacacctagcctggtaccatcagaacctggccaggctcccagacctcctnatctatgatgcatcccaccgagggcccacgtggtctccccagccaggttcagtggcaggtgggtctggggacnggngttcactcncacatcagcagcctgcagtctagaagtattttgcttagtttattagttgtcagtctagttatgtatcgagtcggcctcgatcctaccgttcggccgacggggacacggacgtacggaactaaataaacgacgtgtcggactcgacactac

SEQ ID NO: 360020 - DNA, 497 bp, Homo sapiens
  misc_feature: GZ8MTXP02FJNMU.38.1.A01.1.454.CMB.2.raw
  modified_base (194)..(194): a, c, t, g, unknown or other
  misc_feature (194)..(194): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
  modified_base (385)..(385): a, c, t, g, unknown or other
  misc_feature (385)..(385): n is a, c, g, or t
  modified_base (413)..(413): a, c, t, g, unknown or other
  misc_feature (413)..(413): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagaacaacctagcctggtaccatcagaaacctggccaggctcccagactcctcatctatgatgcatccaccagggcccatggtcgtccccagccaggttcagtggcagtgggtctggggacngagttcactcncaccatcagcagcctgcagtcngaagtatttgctagtttattatgtcagnagtatgatcagtggcctcgatcaccgttcggccgaggggacacgactacggaacaaagtaaacgaacgtgtacggctagcacca

SEQ ID NO: 360021 - DNA, 561 bp, Homo sapiens
  misc_feature: GZ8MTXP02JJQJY.38.1.A01.1.454.CMB.2.raw
  modified_base (195)..(195): a, c, t, g, unknown or other
  misc_feature (195)..(195): n is a, c, g, or t
  modified_base (351)..(351): a, c, t, g, unknown or other
  misc_feature (351)..(351): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccatccaccctgtctgtgtctccgagggganagagccaccctctcctgcagggccagtcagagtgttagtaacactagcctggtaccatcagaacctggccaggctcccagactcctcatctatgatgcatccacgagggccacgtggtcgtcccagccaggttcagtggcaggtgggtctgggacnggtagttcactctcaccatcagtacgcctgcagtctagaagtatttgacttagtttatttattgtctagtctagttatgtatacgtagttcggccctccgtactccgtacccgttcgggacccgaagggggaccaacggtaccgtacgggaaaccctaaaacgtaaaaccggaacgtacggtacggactacgacccaacccgtatttccg

SEQ ID NO: 360022 - DNA, 551 bp, Homo sapiens
  misc_feature: GZ8MTXP02HRX5J.38.1.A01.1.454.CMB.2.raw
  modified_base (192)..(192): a, c, t, g, unknown or other
  misc_feature (192)..(192): n is a, c, g, or t
  modified_base (355)..(355): a, c, t, g, unknown or other
  misc_feature (355)..(355): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagtaacacctagcctggtaccatcagaacctggccaggctcccagacctcctcatctatgatgcatcccaccgagggcccacgtggtcgtcccagccaggttcagtggcaggtgggtctgggacagngttcactctcacatcagcagcctgcagtctagaagttatttgcttagtttattatttgtcagtcagttatgtatcgaggtcggccttccgatccgtacccgtttcgggcccgtaagggggaccaacgggtaacgtacgggaaacctaaacgtaaaaccgtaacgttggtacggtactcggacctaccgtatttccg

SEQ ID NO: 360023 - DNA, 585 bp, Homo sapiens
  misc_feature: GZ8MTXP02JTBVV.38.1.A01.1.454.CMB.2.raw
  modified_base (357)..(357): a, c, t, g, unknown or other
  misc_feature (357)..(357): n is a, c, g, or t
  modified_base (391)..(391): a, c, t, g, unknown or other
  misc_feature (391)..(391): n is a, c, g, or t
  modified_base (398)..(398): a, c, t, g, unknown or other
  misc_feature (398)..(398): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcagggccagtcagagtgttagtaacaacctagcctggtaccatcagaacctggccaggcctcccagacctcctcatctatgatgcatcccaccgagggccacgtggtctcccagccaggttcagtggcaggtgggtctgggacnggtgttcactctacacatcagcagcctgcagtcngaagttntttgacttagtttattagttgtactagtactagttagtagtagtacgtaggtccggtaccctaccgtactacccgtacccggttccgggaccggtaacgggggaacccaacggtaccgtacggaaaacctaaaacggtaaaaccggtaacgttacgggtacggtacgtacggtaccctaaccgtacg

SEQ ID NO: 360024 - DNA, 548 bp, Homo sapiens
  misc_feature: GZ8MTXP02HSJ82.38.1.A01.1.454.CMB.2.raw
  modified_base (282)..(282): a, c, t, g, unknown or other
  misc_feature (282)..(282): n is a, c, g, or t
tcagtcgatcacgtcacgaccggtgctcgatttagacgtctcatcgagggggaactgctcagttaggacccagacggaaccatggaagccccagcgcagcttctcttcctcctgatactctggcctcccagaaatcactggagaaatcgtgatgacgaagtctccagccaccctgtctgtgtctccgaggggagagagccaccctctcctgcagggccagtcagagtgttagtaacacctagcctggtaccatcagaacctggccaggctcccagactcctnatctatgatgcatcccaccgagggccacgtggtcgtccccagccaggttcaggtggccagggtgggtctggggacaggtagttccactcctacacccatccagccagcctgctagtctagtaagttattttgacttagtttattagttgttcagtactagtatgatcgagtcggcctcgatccgaccgttcggaccgtacggggacacgacgtacggaactaaaacgtaaacgacgtggtacgacgtacgacctacctattcttcg

SEQ ID NO: 360025 - DNA, 480 bp, Homo sapiens
  misc_feature: GZ8MTXP02F2ZSZ.38.1.A01.1.454.CMB.2.raw
  modified_base (346)..(346): a, c, t, g, unknown or other
  misc_feature (346)..(346): n is a, c, g, or t
tcagtcgatcacgtcacgaccggtgctcgatttagacgtctcatcaggggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagtaacaacctagcctggtaccatcaagaacctggccaggctcccagactcctcatctatgatgcatccacaggccactggtctcccagccaggttcagtcgcagtggtctgggacaggngttcactctcaccatcagcagcctgcagtctagagtatttgctagtttattattgtctagctagtatgatcagtgctcgatcactcgcagggacacgactcgaacaagtaaacgaacgtgtaggctgcacatcg

SEQ ID NO: 360026 - DNA, 484 bp, Homo sapiens
  misc_feature: GZ8MTXP02GYM24.38.1.A01.1.454.CMB.2.raw
  modified_base (194)..(194): a, c, t, g, unknown or other
  misc_feature (194)..(194): n is a, c, g, or t
  modified_base (311)..(311): a, c, t, g, unknown or other
  misc_feature (311)..(311): n is a, c, g, or t
  modified_base (343)..(343): a, c, t, g, unknown or other
  misc_feature (343)..(343): n is a, c, g, or t
  modified_base (375)..(375): a, c, t, g, unknown or other
  misc_feature (375)..(375): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacactagcctggtaccatcagaaacctggccaggctcccagactcctcatctatgatgcatccacagggccactggntcccagccaggttcagtgcagtggctgggacngagttcactctcacatcagcagcctgcagtcngaagtatttgctagtttattattgtcagctagtatgatcagtcgctcgatcaccttcggccaggggacacgactaggaacaaagtaaacgaactggtacgctcgcacta

SEQ ID NO: 360027 - DNA, 525 bp, Homo sapiens
  misc_feature: GZ8MTXP02GUG3Y.38.1.A01.1.454.CMB.2.raw
  modified_base (275)..(275): a, c, t, g, unknown or other
  misc_feature (275)..(275): n is a, c, g, or t
  modified_base (343)..(343): a, c, t, g, unknown or other
  misc_feature (343)..(343): n is a, c, g, or t
tcagtcgatcacgtcacgaccggtgctcgatttagacgtctcatcaggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagtaacaactagcctggtaccatcagaactgcaggctccagctcncatctatgatgcatccacgaggccacgtggtcgtcccagccaggttcaggtgcagtgggtctgggacnggagttcactctccaacatcagcagcctgcagtctgaagtatttgactagtttattattgtctagctaagtatgtatcgtagtcggcctaccgactcctacccgttcggaccgaacggggaccaacggaccgtaggaaactaaaacgtaaaacgtacgtaggtacggctacgaccaacctag

SEQ ID NO: 360028 - DNA, 484 bp, Homo sapiens
  misc_feature: GZ8MTXP02IFK5D.38.1.A01.1.454.CMB.2.raw
  modified_base (192)..(192): a, c, t, g, unknown or other
  misc_feature (192)..(192): n is a, c, g, or t
  modified_base (345)..(345): a, c, t, g, unknown or other
  misc_feature (345)..(345): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagtaacacctagcctggtaccatcagaactggccagctccagactctcatctatgatgcatccaccagggccagtggtctcccagccaggttcagtcggcagtgggtctgggacagngttcactctcaccatccagcagcctgcagtctgaagtattttgctagtttattattgtacagtctagtatgatcagtgctcgatcacgttcgcgagggacacgactggaacaagtaaacgaacgtgtagctagcacatc

SEQ ID NO: 360029 - DNA, 508 bp, Homo sapiens
  misc_feature: GZ8MTXP02J0HLO.38.1.A01.1.454.CMB.2.raw
  modified_base (194)..(194): a, c, t, g, unknown or other
  misc_feature (194)..(194): n is a, c, g, or t
  modified_base (284)..(284): a, c, t, g, unknown or other
  misc_feature (284)..(284): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
  modified_base (416)..(416): a, c, t, g, unknown or other
  misc_feature (416)..(416): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagaacaactagcctggtaccatcagaacctggcccaggcctcccagacctcctnatctatgatgcatcccaccgagggccacgtggtctccccagcccaggttcaggtggcagtggggtcnggggacnggagttcactcncaccatccagcagccctgcagtctagagtatttgcttagtttattnttgtctagcagtatgatcagtcgcctcgatccaccgttcggccgagggaccacgacgtacgaacaaagtaacgactgacggctcgacaccta

SEQ ID NO: 360030 - DNA, 505 bp, Homo sapiens
  misc_feature: GZ8MTXP02F68AM.38.1.A01.1.454.CMB.2.raw
  modified_base (191)..(191): a, c, t, g, unknown or other
  misc_feature (191)..(191): n is a, c, g, or t
  modified_base (344)..(344): a, c, t, g, unknown or other
  misc_feature (344)..(344): n is a, c, g, or t
  modified_base (410)..(410): a, c, t, g, unknown or other
  misc_feature (410)..(410): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacacctagcctggtaccatcagaacctggccaggctccagactctcatctatgatgcatccaccagggccactggtctcccagccaggttcagtggcagtggtctgggacagngttcactctcaccatcagcagccctgcagtctgaagtattttgctagtttattaattgtctagtanagtatagatagtagtcgtctcgtactactacgtcgtacggacggacgacgacgtacgaacgaactaaacgaacgtagtacgcgtacgacacactc

SEQ ID NO: 360031 - DNA, 552 bp, Homo sapiens
  misc_feature: GZ8MTXP02H5O7R.38.1.A01.1.454.CMB.2.raw
  modified_base (278)..(278): a, c, t, g, unknown or other
  misc_feature (278)..(278): n is a, c, g, or t
  modified_base (352)..(352): a, c, t, g, unknown or other
  misc_feature (352)..(352): n is a, c, g, or t
  modified_base (370)..(370): a, c, t, g, unknown or other
  misc_feature (370)..(370): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgagggagagagccaccctctcctgcagggccagtcagagtgttagaacactagcctggtaccatcagaaacctggccaggctcccagactcctnatctatgatgcatccacagggccacgtggtcgtcccagcccaggttcaggtcggcaggtgggctggggacaggngttcactctcaccatcancagcctgcagtctgaagtatttgacttagtttattatttgtctagtcagtatgaatcgagtcggtctccggtatccgtaacccgttcggaccgacgggggaccaacggaccgtaacgggaaccgtaaagtaaaaccgtaaccgtaggttacggaccgttacggcccgtaacctacgttaccg

SEQ ID NO: 360032 - DNA, 504 bp, Homo sapiens
  misc_feature: GZ8MTXP02F069O.38.1.A01.1.454.CMB.2.raw
  modified_base (194)..(194): a, c, t, g, unknown or other
  misc_feature (194)..(194): n is a, c, g, or t
  modified_base (353)..(353): a, c, t, g, unknown or other
  misc_feature (353)..(353): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagaacacctagcctggtaccatcagaaacctggccaggctcccagacctcctcatctatgatgcatcccaccgaggggccacgtggtcgtccccagccaggttcagtgcagtggtctgggacnggattcactctcacatcagcagcctgcagtcagaagtattttgactagtttattattgtactagctagtatcgatcagtcgcctcgtatcaccttcggccaggggaccacgacgtaggacaaagtaacgaactggtacggctcgacactac

SEQ ID NO: 360033 - DNA, 522 bp, Homo sapiens
  misc_feature: GZ8MTXP02F5ASG.38.1.A01.1.454.CMB.2.raw
  modified_base (195)..(195): a, c, t, g, unknown or other
  misc_feature (195)..(195): n is a, c, g, or t
  modified_base (357)..(357): a, c, t, g, unknown or other
  misc_feature (357)..(357): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagaacaacctagcctggtaccatcagaacctggccaggctcccagacctcctcatctatgatgcatcccaccgagggcccacgtggtcgtcccagccaggttcaggtgcaggtgggtctggggacnggagttcactctcaacatcagcacgctgcagtctagaagtatttgactagtttattattgtctagtctagtatgatcgagtcgcctacgatccgtaccgttcggaccgacggggacacgacgtacggaactaaagtaaacgaacgtggtacggctacgacaccta

SEQ ID NO: 360034 - DNA, 504 bp, Homo sapiens
  misc_feature: GZ8MTXP02FR7QP.38.1.A01.1.454.CMB.2.raw
  modified_base (194)..(194): a, c, t, g, unknown or other
  misc_feature (194)..(194): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (387)..(387): a, c, t, g, unknown or other
  misc_feature (387)..(387): n is a, c, g, or t
  modified_base (439)..(439): a, c, t, g, unknown or other
  misc_feature (439)..(439): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacaacctagcctggtaccatcagaaacctggccaggctcccagacctcctcatctatgatgcatcccaccagggccactggtcgtccccagccaggttcagtggcaggtgggtctggggacngagttcactcncacatcagcagctgcagtcngaagtattttgactagtttaattattgtcagctagtatgatcagtgcctcgntcacttcggccacggggacacgacgtaggaacaaagtaaacgaacgtacgtaggctcgacaccta

SEQ ID NO: 360035 - DNA, 498 bp, Homo sapiens
  misc_feature: GZ8MTXP02FW28E.38.1.A01.1.454.CMB.2.raw
  modified_base (195)..(195): a, c, t, g, unknown or other
  misc_feature (195)..(195): n is a, c, g, or t
  modified_base (352)..(352): a, c, t, g, unknown or other
  misc_feature (352)..(352): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagtaacaacctagcctggtaccatcagaaacctggccaggctcccagactcctcatctatgatgcatcccacagggccactggtcgtcccagccaggttcagtggcagtgggtctgggacnggagttcactctcaccatcagcagcctgcagtctgaagtatttgactagtttattattgtcagctagtatgatcagtcgcctcgatcacttcggacaggggacacgactacggaacaaataaacgactggtacggctacgcaccta

SEQ ID NO: 360036 - DNA, 540 bp, Homo sapiens
  misc_feature: GZ8MTXP02G67HG.38.1.A01.1.454.CMB.2.raw
  modified_base (193)..(193): a, c, t, g, unknown or other
  misc_feature (193)..(193): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagagcccaccctctcctgcagggccagtcagagtgttagtaacacctagcctggtaccatcagaaacctggccaggcctcccagacctcctcatctatgatgcatcccaccgaggccacgtgggtctcccagccaggttcaggtcggcaggtgggtctggggacagtgttcactctccacatcagcagcctgcagtctagaagtattttgacttagtttattagttgtactagtactagttatgtatcgtaggtcggtcctccgtatccgtaccgttcggaccgaggggaccaacggacgtacggaactaaagtaaacgaacgtgtacggctagaccaccgtatccg

SEQ ID NO: 360037 - DNA, 498 bp, Homo sapiens
  misc_feature: GZ8MTXP02GRLJ6.38.1.A01.1.454.CMB.2.raw
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagaacaacctagcctggtaccatcagaacctggccaggctcccagactcctcatctatgatgcatccaccgagggcccacgtggctcccagccaggttcaggtggcaggtggggtctggggacaggcgttcactctcaccatcagcagccctgcagtctgaagtatttgactagtttattattgtcagctagtatgatcagtcgcctcgatctacttcggcgacggggacacgacgtagaacaaataaacgactgtcggctgacacta

SEQ ID NO: 360038 - DNA, 517 bp, Homo sapiens
  misc_feature: GZ8MTXP02G8PZ7.38.1.A01.1.454.CMB.2.raw
  modified_base (192)..(192): a, c, t, g, unknown or other
  misc_feature (192)..(192): n is a, c, g, or t
  modified_base (400)..(400): a, c, t, g, unknown or other
  misc_feature (400)..(400): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagaacacctagcctggtaccatcagaacctggccaggctcccagacctcctcatctatgatgcatcccaccagggccacgtgggtctccccagccctaggttcaggtcggcaggtcggggtctggggaccaggtgttcactctcaccatcagcagcctgcagtctagaagtntttgacttagtttattattgtcagtctagtatgtatgaggtcgcctcgatcgaccgttcggaccgtagggaccacgacgtacggaacaataaacgaactggtacgctgacactatcg

SEQ ID NO: 360039 - DNA, 555 bp, Homo sapiens
  misc_feature: GZ8MTXP02I1EO6.38.1.A01.1.454.CMB.2.raw
  modified_base (285)..(285): a, c, t, g, unknown or other
  misc_feature (285)..(285): n is a, c, g, or t
  modified_base (475)..(475): a, c, t, g, unknown or other
  misc_feature (475)..(475): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctcctgcagggccagtcagagtgttagtaacacctagcctggtaccatcagaacctggccaggctcccagacctccncatctatgatgcactcccaccgagggcccacgtggtctccccagcccaggttcaggtggcaggtcggggtctaggggacaggtacgttcacgtcctacaccatcagcacgcctgctagtctagtaagtatttgacttaagttttattattcgtactagtactagttatgatacgtaggtcgtctaccgtnttaccgtaccgttcggaccgacggggacacggtacgtacggaacaaacgtaaacgactacggtacggctcgacctactac

SEQ ID NO: 360040 - DNA, 522 bp, Homo sapiens
  misc_feature: GZ8MTXP02GFAIY.38.1.A01.1.454.CMB.2.raw
  modified_base (195)..(195): a, c, t, g, unknown or other
  misc_feature (195)..(195): n is a, c, g, or t
  modified_base (282)..(282): a, c, t, g, unknown or other
  misc_feature (282)..(282): n is a, c, g, or t
  modified_base (351)..(351): a, c, t, g, unknown or other
  misc_feature (351)..(351): n is a, c, g, or t
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
  modified_base (420)..(420): a, c, t, g, unknown or other
  misc_feature (420)..(420): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagaacacctagcctggtaccatcagaacctggccaggcctccagacctccnatctatgatgcatcccacgaggccacgtggtctcccagcctaggttcaggtgcaggtcggtctgggacnggngttcactctacacntcagcacgcctgcagtctagtaagtatttgacttagtttattattgtcagtntaagtatgtatcgtaggtcgcctacgtatccgtaccgttcggacgaacgggacacgacgtaggaactaaacgtaaacgacgtggtacggctcgaccactacg

SEQ ID NO: 360041 - DNA, 507 bp, Homo sapiens
  misc_feature: GZ8MTXP02HLLN1.38.1.A01.1.454.CMB.2.raw
  modified_base (191)..(191): a, c, t, g, unknown or other
  misc_feature (191)..(191): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (430)..(430): a, c, t, g, unknown or other
  misc_feature (430)..(430): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagaacacctagcctggtaccatcagaaacctggccaggctcccagacctcctcatctatgatgcatcccaaccagggcccactgggtcgtccccagcccaagggttccaggtcggctaggtgggtctgggacagngtttcactcncaccancagcagcctgcagtctagaagtatttgctagtttattattgttcagtcagtntgatcagtcggctcgatcaccgttcggcgagggacacgactcggaacaataaacgaacgtgtaggctgcacctatcg

SEQ ID NO: 360042 - DNA, 499 bp, Homo sapiens
  misc_feature: GZ8MTXP02F1KUU.38.1.A01.1.454.CMB.2.raw
  modified_base (195)..(195): a, c, t, g, unknown or other
  misc_feature (195)..(195): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
  modified_base (387)..(387): a, c, t, g, unknown or other
  misc_feature (387)..(387): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagaacaacctagcctggtaccatcagaaacctggccaggcctcccagacctcctcatctatgatgcatcccacagggccagtggtcgtccccagccaggttcagtggcaggtgggtcngggacnggattcactcncacatcagcagcctgcagtcngaagtatttgactagtttatattgtcagctagtatgatcagtgcctcgatcacgttcggacaggggacacgactacggaacaaagtaaacgaacgtgtacggctcgacacta

SEQ ID NO: 360043 - DNA, 549 bp, Homo sapiens
  misc_feature: GZ8MTXP02G2BQB.38.1.A01.1.454.CMB.2.raw
  modified_base (195)..(195): a, c, t, g, unknown or other
  misc_feature (195)..(195): n is a, c, g, or t
  modified_base (285)..(285): a, c, t, g, unknown or other
  misc_feature (285)..(285): n is a, c, g, or t
  modified_base (362)..(362): a, c, t, g, unknown or other
  misc_feature (362)..(362): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttataacaacctgcctggtaccatcagaacctggccaggcctcccagacctcctnatctatgatgcactcccacacgggccacgtggtcgtccccagcctagggttcaggtggcaggtcgggtctggggacnggtacgttcactctcacatccagcagcctgctagtctaggaagttattttgacttagtttattatttgtactagtctagttatgtatcgtagtcggcctaccgatacccgtaccgttcggaccgtacggggacaccggtacgtacggaactaaaagtaaaccgaacgtggtacggctcgaccaactc

SEQ ID NO: 360044 - DNA, 484 bp, Homo sapiens
  misc_feature: GZ8MTXP02F6NU2.38.1.A01.1.454.CMB.2.raw
  modified_base (348)..(348): a, c, t, g, unknown or other
  misc_feature (348)..(348): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggaagagagcccaccctctcctgcagggccagtcagagtgttagtaacacctagcctggtaccatcagaacctggccaggctcccagactcctcatctatgatgcatccaccagggccactggtctcccagccaggttcagtcggcagtggtctgggacagngttcactctcaccatcagcagcctgcagtctagagtattttgctagtttattattgtcagtcagtatgatcagtgctcgatcacttcggcgagggacacgactcgaacaataaacgaactgtaggctgacaccatc

SEQ ID NO: 360045 - DNA, 514 bp, Homo sapiens
  misc_feature: GZ8MTXP02GNID5.38.1.A01.1.454.CMB.2.raw
  modified_base (193)..(193): a, c, t, g, unknown or other
  misc_feature (193)..(193): n is a, c, g, or t
  modified_base (205)..(205): a, c, t, g, unknown or other
  misc_feature (205)..(205): n is a, c, g, or t
  modified_base (268)..(268): a, c, t, g, unknown or other
  misc_feature (268)..(268): n is a, c, g, or t
  modified_base (348)..(348): a, c, t, g, unknown or other
  misc_feature (348)..(348): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (415)..(415): a, c, t, g, unknown or other
  misc_feature (415)..(415): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctccagaaatcactggagaaatcgtgatgacgcagtctccagccaccctgtctgtgtctccagggganagagccaccctntcctgcagggccagtcagagtgttagaacactagcctggtaccatcagaaacctggccaggcncccagactcctcatctatgatgcatcccaccagggccactggtcgtcccagcaggttcagtggcagtgggtctggggacngagttcactctcaccatcagcagcctgcagtcagattacgttnattattattgtntananatagtanagatagtcgtcgcctcgtactccgtaccgtacggacggacggacacgtacgaacgaaacaaaacgaaacgtacgtacggtacgacgtacgacctactac

SEQ ID NO: 360046 - DNA, 492 bp, Homo sapiens
  misc_feature: GZ8MTXP02JYD0L.38.1.A01.1.454.CMB.2.raw
  modified_base (191)..(191): a, c, t, g, unknown or other
  misc_feature (191)..(191): n is a, c, g, or t
  modified_base (280)..(280): a, c, t, g, unknown or other
  misc_feature (280)..(280): n is a, c, g, or t
  modified_base (351)..(351): a, c, t, g, unknown or other
  misc_feature (351)..(351): n is a, c, g, or t
  modified_base (408)..(408): a, c, t, g, unknown or other
  misc_feature (408)..(408): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacaactagcctggtaccatcagaaacctggccaggctcccagacctccncatctatgatgcatccaccagggccacgtggtcgtcccagccaggttcagtggcagtgggtctgggacagngttcactctcaccatcagcagcctgcagtctgaagtatttgctagtttattattgtnagcagtatgatcagtcggcctcgatcaccttcggccgaggggacacgacgtacgacaataaacgaacgtgtacgctgcacatcg

SEQ ID NO: 360047 - DNA, 491 bp, Homo sapiens
  misc_feature: GZ8MTXP02F9BZP.38.1.A01.1.454.CMB.2.raw
  modified_base (191)..(191): a, c, t, g, unknown or other
  misc_feature (191)..(191): n is a, c, g, or t
  modified_base (342)..(342): a, c, t, g, unknown or other
  misc_feature (342)..(342): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (479)..(479): a, c, t, g, unknown or other
  misc_feature (479)..(479): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacacctagcctggtaccatcagaacctggccaggctcccagactcctcatctatgatgcatccaccaggccactggtgtcccagccaggttcagtcgcagtgggctggacngngttcactntcacatcancagccctgcagtctagaagtatttgactagtttattattgtcagtcagttatgatcaggtcggcctcgatccaccgttcggccgagggacacgacgtcggaacaagtaaacgaagtgngactgcacatcg

SEQ ID NO: 360048 - DNA, 559 bp, Homo sapiens
  misc_feature: GZ8MTXP02HJDU8.38.1.A01.1.454.CMB.2.raw
  modified_base (193)..(193): a, c, t, g, unknown or other
  misc_feature (193)..(193): n is a, c, g, or t
  modified_base (422)..(422): a, c, t, g, unknown or other
  misc_feature (422)..(422): n is a, c, g, or t
  modified_base (542)..(542): a, c, t, g, unknown or other
  misc_feature (542)..(542): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggcccccagaaatcactggagaaatcgtgatgacgcagtctccagccaccctgtctgtgtctccgagggganagacgccaccctctcctgcagggccagtcagagtgttaagtaacaactagcctggtaccatcaagaaacctggccaggcctcccagacctcctcatctatgatgcactccaccagggccagtcggtctcccagcccgaggttcaggttcggccgtagggttcggggtcgtaggggactaggacgtttccacttcacacccatcagccagccctgcagtctagtaagttntttgacttagtttattattgttacagtacgtagtatgatcgtaggtcgcctcgactccgtaccgttcggaccgaaggggccacgacgtacgaacaaaagtaaacgaacgttgacggtacncgaccacctattctacg

SEQ ID NO: 360049 - DNA, 501 bp, Homo sapiens
  misc_feature: GZ8MTXP02G281K.38.1.A01.1.454.CMB.2.raw
  modified_base (350)..(350): a, c, t, g, unknown or other
  misc_feature (350)..(350): n is a, c, g, or t
  modified_base (353)..(353): a, c, t, g, unknown or other
  misc_feature (353)..(353): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagtaacaacctagcctggtaccatcagaaacctggccaggctcccagactcctcatctatgatgcatccacagggccacgtggtctcccagccaggttcagtgcagtgggtctgggacnggngttcactctcaccatcagcagcctgcagtctagaagtatttgactagtttattattgtcagcagtatgatcagtcgcctcgatctaccttcggctaggggacacggacgtacggaacaagtaaacgactggtacggctacgcacctag

SEQ ID NO: 360050 - DNA, 527 bp, Homo sapiens
  misc_feature: GZ8MTXP02H33V6.38.1.A01.1.454.CMB.2.raw
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (431)..(431): a, c, t, g, unknown or other
  misc_feature (431)..(431): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccacctgtctgtgtctcgagggagagacgcccaccctctcctgcagggccagtcagagtgttagaacactgcctgacatcagaacngcagcnccagctcnatctatgatgcactcccaacgacgggccacgtggtcgtcccagccctaggttcaggtcggctagggtgggtcgtggggactaggcgttcacttcctacaccatcacgcacgctagctagtctagtaagtattttgactttagtttattattgtacagtacagttangtactgaggtcgcctcgactccgaccgttcggacgagggacacggactacggaacaaagtaaaccgaagtgtacggctacggcctaaccgtatccg

SEQ ID NO: 360051 - DNA, 500 bp, Homo sapiens
  misc_feature: GZ8MTXP02IRWJO.38.1.A01.1.454.CMB.2.raw
  modified_base (191)..(191): a, c, t, g, unknown or other
  misc_feature (191)..(191): n is a, c, g, or t
  modified_base (282)..(282): a, c, t, g, unknown or other
  misc_feature (282)..(282): n is a, c, g, or t
  modified_base (346)..(346): a, c, t, g, unknown or other
  misc_feature (346)..(346): n is a, c, g, or t
  modified_base (382)..(382): a, c, t, g, unknown or other
  misc_feature (382)..(382): n is a, c, g, or t
  modified_base (406)..(406): a, c, t, g, unknown or other
  misc_feature (406)..(406): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttaagtaacaacctagcctggtaccatcagaacctggccaggctcccagacctcctnatctatgatgcatccacaggccagtggtctcccagccaggtcagtcgcagtggtctgggacagngttcactctcacatcagcagctgcagtctagaagtntttgctagtttattattgtcagtnagtatgatcagtcgcctcgatcaccgttcggccgaggggacacgacgtacggaactaaagtaaacgaacgtggtacggactgaccacgtattcg

SEQ ID NO: 360052 - DNA, 554 bp, Homo sapiens
  misc_feature: GZ8MTXP02HKEEO.38.1.A01.1.454.CMB.2.raw
  modified_base (431)..(431): a, c, t, g, unknown or other
  misc_feature (431)..(431): n is a, c, g, or t
  modified_base (554)..(554): a, c, t, g, unknown or other
  misc_feature (554)..(554): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagtaacaacctagcctggtaccatcagaacctggccaggcctcccagacctcctcatctatgatgcactcccacgacgggcccacgtggtctcccagccgtaggttcaggtcggctagggtcggggtcgtaggggacagggtacgttccaccttcctaccgacccatccaacgccacgtcctggctagtctagaaagttnttttcggattagttttattagtttcgctagctagttatgatcgaggtcgcctacgatcctaccgtcggaccgaggggtaccacgacgtagaacaaaagtaaacgctaggtcgactcgacactn

SEQ ID NO: 360053 - DNA, 563 bp, Homo sapiens
  misc_feature: GZ8MTXP02ITIBE.38.1.A01.1.454.CMB.2.raw
  modified_base (193)..(193): a, c, t, g, unknown or other
  misc_feature (193)..(193): n is a, c, g, or t
  modified_base (397)..(397): a, c, t, g, unknown or other
  misc_feature (397)..(397): n is a, c, g, or t
  modified_base (432)..(432): a, c, t, g, unknown or other
  misc_feature (432)..(432): n is a, c, g, or t
tcagtcgatcacgtcacgaccggtgctcgatttagacgtctcatcagggggaactgctcagttaggacccagacggaaccatggaagccccagcgcagcttctcttcctcctgatactctggcctcccagaaatcactggagaaatcgtgatgacgcagtctccagccaccctgtctgtgtctccgagggganagacgccaccctctcctgcagggccagtcagagtgttagtaacacctagcctggtaccatcagaaacctggaccaggcctccagacctcctcatctatgatgccatcccaccgagggccacgtgggtctcccagccgtaggttcaggtcggcaggtcgggtctgggacagcgtttcactctaccaccatcgagcagccctgacngtctagtagttatttcgacttagtttatttagttntcgagtctagttatcgatcgagtcggaccttcgactccgaccgttcggaccgtaaggggaccacggtaacgtacggaaactaaaacgtaaacggtaacgtggacggtacctacgacctaccctagtttccg

SEQ ID NO: 360054 - DNA, 539 bp, Homo sapiens
  misc_feature: GZ8MTXP02GPX2D.38.1.A01.1.454.CMB.2.raw
  modified_base (191)..(191): a, c, t, g, unknown or other
  misc_feature (191)..(191): n is a, c, g, or t
  modified_base (282)..(282): a, c, t, g, unknown or other
  misc_feature (282)..(282): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
  modified_base (420)..(420): a, c, t, g, unknown or other
  misc_feature (420)..(420): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccacccctctcctgcagggccagtcagagtgttagtaacaacctagcctggtaccatcagaaacctggccaggctcccagactcctnatctatgatgcatccacaggccatggtctcccagccaggttcaggtcgcagtggtctggggacagngttcactctcacatcancagcctgcagtctagaagtattttgcttagtttattattgtacagtctaaggttntagtactcgaaggttcggacccttccgatccgtacccgtttcgggacccgagggggacctacggaccgttggaaaaccaaagtaaaccgaacgtgtacggtactcgaccaccatttccg

SEQ ID NO: 360055 - DNA, 499 bp, Homo sapiens
  misc_feature: GZ8MTXP02HFZAL.38.1.A01.1.454.CMB.2.raw
  modified_base (193)..(193): a, c, t, g, unknown or other
  misc_feature (193)..(193): n is a, c, g, or t
  modified_base (448)..(448): a, c, t, g, unknown or other
  misc_feature (448)..(448): n is a, c, g, or t
  modified_base (468)..(468): a, c, t, g, unknown or other
  misc_feature (468)..(468): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagaacacctgcctggtaccatcagaacctggccaggcctccagactcctcatctatgatgcatccaccagggccagtggtctcccagccaggttcagtcggctaggtgggtctgggacagtcgttcactctcaccatcagcagtcctgcagtctagtaacgtattttggacttagtttacttattgtcagtctagtatgatcgagtcggcctcgatccnccgttcgcgagggcacgacncgaacaataacgaagtgcgctgacactatcg

SEQ ID NO: 360056 - DNA, 524 bp, Homo sapiens
  misc_feature: GZ8MTXP02I6U75.38.1.A01.1.454.CMB.2.raw
  modified_base (194)..(194): a, c, t, g, unknown or other
  misc_feature (194)..(194): n is a, c, g, or t
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (397)..(397): a, c, t, g, unknown or other
  misc_feature (397)..(397): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacaacctagcctggtaccatcagaaacctggccaggcctcccagacctcctnatctatgatgcatcccacgngggcccacgtggtctccccagccaggttcagtgcaggtgggtcnggggacnggtagttcactctccacatcagcagctgcagtctgaagtntttgctagtttattattgtactagtctagtatgattcgagtcgcctcgactccaccgttcggaccgacggggaccacggacgtacggaacctaaagtaaaccgacgtagtacggctacgctactacg

SEQ ID NO: 360057 - DNA, 522 bp, Homo sapiens
  misc_feature: GZ8MTXP02JQMNI.38.1.A01.1.454.CMB.2.raw
  modified_base (195)..(195): a, c, t, g, unknown or other
  misc_feature (195)..(195): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (438)..(438): a, c, t, g, unknown or other
  misc_feature (438)..(438): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgtagtaacactagcctggtaccatcagaaacctggccaggcctcccagacctcctcattctatgatgcatcccacgagggcccacgtggtctccccgagtccaggttcaggtggctaggtgggtctaggggacagggtacttcacgttcctcacctatcagcacgcctgcagtcngaatntttgactagtttatattgtcagctagtangatcgagtgccctcgatcgaccgttcggccgaggggaccacggactacggaacaacgaaacgacgttggcgactcgactactag

SEQ ID NO: 360058 - DNA, 492 bp, Homo sapiens
  misc_feature: GZ8MTXP02I29C1.38.1.A01.1.454.CMB.2.raw
  modified_base (191)..(191): a, c, t, g, unknown or other
  misc_feature (191)..(191): n is a, c, g, or t
  modified_base (350)..(350): a, c, t, g, unknown or other
  misc_feature (350)..(350): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacacctagcctggtaccatcagaaacctggccaggctcccagactcctcatctatgatgcatcccacagggccactgggtctccccagccaggttcagtggcagtgggtctgggacagngttcactctcaccatcagcagcctgcagtctgaagtattttgctagtttattattgtcagtcagtatgatcagtggctccgatcaccttcggcaggggacacgactcggaacaataaacgaacgtgtacggctgcacctatc

SEQ ID NO: 360059 - DNA, 512 bp, Homo sapiens
  misc_feature: GZ8MTXP02GTOUA.38.1.A01.1.454.CMB.2.raw
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagtaacaacctagcctggtaccatcagaaacctggccaggctcccagactcctcatctatgatgcatccacaggccactggtctcccagccaggttcaggtcggcagtgggtctggggacagngttcactctcaccatcagcagcctgcagtctagaatnttttgctagtttattattgtacagtctagtatgatcagtcgctcgatcaccgttcggaccgtaggggaccacggactggaaaccaagtaaaacgaacgtggtacggactacgactaccagttccg

SEQ ID NO: 360060 - DNA, 487 bp, Homo sapiens
  misc_feature: GZ8MTXP02GA36Z.38.1.A01.1.454.CMB.2.raw
  modified_base (351)..(351): a, c, t, g, unknown or other
  misc_feature (351)..(351): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagtaacaacctagcctggtaccatcagaacctggccaggctcccagacctcctcatctatgatgcatccaccagggccacgtggtcgtcccagccaggttcagtcgcagtgggtctgggacagngttcactctcaccatcagcagcctgcagtctagagtatttgctagtttattattgtcagctagtatgatcgagtcgcctcgatcacttcggacgaggggacacgactcgacaataaacgaactgcgctgcacatcg

SEQ ID NO: 360061 - DNA, 533 bp, Homo sapiens
  misc_feature: GZ8MTXP02HVCJF.38.1.A01.1.454.CMB.2.raw
  modified_base (195)..(195): a, c, t, g, unknown or other
  misc_feature (195)..(195): n is a, c, g, or t
  modified_base (289)..(289): a, c, t, g, unknown or other
  misc_feature (289)..(289): n is a, c, g, or t
  modified_base (352)..(352): a, c, t, g, unknown or other
  misc_feature (352)..(352): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagaacacctagcctggtaccatcagaacctggccaggctcccagactcctcatctatnatgcatcccacagggccacgtggtctcccagccaggttcagtggctaggtgggtctggggacnggagttcactctcaccatcagcagcctgctagtctagaagtctttgctagttttattattgtactagtctagtatgaatcgtagtcgccttacgacttaccgaccgttcggaccgacggggaccacggacgtacggaactaaaagtaaaaccgaacgtggtacggactcggacaaccctag

SEQ ID NO: 360062 - DNA, 499 bp, Homo sapiens
  misc_feature: GZ8MTXP02HBF54.38.1.A01.1.454.CMB.2.raw
  modified_base (192)..(192): a, c, t, g, unknown or other
  misc_feature (192)..(192): n is a, c, g, or t
  modified_base (298)..(298): a, c, t, g, unknown or other
  misc_feature (298)..(298): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagaacaacctagcctggtaccatcagaacctggccaggctccagactcctcatctatgatgcatcccacnggccagtggtctcccagcctaggttcaggtcggcaggtgggtctggggacaggtgttccactctacaccatcagcagcctgcagtctagaagtatttgctagtttattattgtacagtcagtatgatcgagtcggctcgatcaccttcggcgagggacacgactggaacaagtaaacgaagtgtacggctgactacacttc

SEQ ID NO: 360063 - DNA, 505 bp, Homo sapiens
  misc_feature: GZ8MTXP02HMBCQ.38.1.A01.1.454.CMB.2.raw
  modified_base (191)..(191): a, c, t, g, unknown or other
  misc_feature (191)..(191): n is a, c, g, or t
  modified_base (308)..(308): a, c, t, g, unknown or other
  misc_feature (308)..(308): n is a, c, g, or t
  modified_base (342)..(342): a, c, t, g, unknown or other
  misc_feature (342)..(342): n is a, c, g, or t
  modified_base (355)..(355): a, c, t, g, unknown or other
  misc_feature (355)..(355): n is a, c, g, or t
  modified_base (379)..(379): a, c, t, g, unknown or other
  misc_feature (379)..(379): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgtagtaacacctagcctggtaccatcagaacctggccaggctcccagacctcctcatctatgatgcatccacaggccatggtcnccagccaggttcagtcgcagtggtctgggacagngttcactctcacntcagcagcctgcagtctagaagtntttgcttagtttattattgtacagtcagtatgatcaggtgcctcgatcaccgttcggccgaggggaccacggacgtacggaacaaacgtaaacgaacgtggtacggtactggaccaccgtattccg

SEQ ID NO: 360064 - DNA, 510 bp, Homo sapiens
  misc_feature: GZ8MTXP02H0GLD.38.1.A01.1.454.CMB.2.raw
  modified_base (283)..(283): a, c, t, g, unknown or other
  misc_feature (283)..(283): n is a, c, g, or t
  modified_base (355)..(355): a, c, t, g, unknown or other
  misc_feature (355)..(355): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtcctccgaggggagagagccaccctctcctgcagggccagtcagagtgttagaacactagcctggtaccatcagaacctggccaggcctccagacctcctnatctatgatgcactcccacgagggcccagtggtctcccagccaggttcaggtggcaggtgggtctggggacnggtgttcactctcacatcagcagcctgcagtcagagtntttgntagtttattattgtcagtctagtatgatcgagtcgcctacgatccgtaccgttcggaccgagggacacgacgtacggaacaaagtaaacgacttaggcgactacgccaacta

SEQ ID NO: 360065 - DNA, 541 bp, Homo sapiens
  misc_feature: GZ8MTXP02II8G5.38.1.A01.1.454.CMB.2.raw
  modified_base (193)..(193): a, c, t, g, unknown or other
  misc_feature (193)..(193): n is a, c, g, or t
  modified_base (210)..(210): a, c, t, g, unknown or other
  misc_feature (210)..(210): n is a, c, g, or t
tcagtcgatcacgtcacgaccggtgctcgatttagacgtctcatcagggggaactgctcagttaggacccagacggaaccatggaagccccagcgcagcttctcttcctcctgatactctgactcccagaaatcactggagaaatcgtgatgacgcagtctccagcccaccctgtctgtgtctccgagggganagagcccaccctctccngcagggccagtcagagtgttaagaacacctagcctggtaccatcagaacctggccaggctcccagacctcctcatctatgatgcactcccaccgagggccacgtgggtctcccagccaggttcagtcggactaggtgggtctaggggacagtgttcactcctaccaccatccagcagcctgcagtctagaagttatttgacttagtttattagtttgtacagtactagtatagtatcgaggtcgcctcgactctaccgttcggcgacggggacaacggacgtcggaaactaagtaaacgtaacgtgtacggacgtacgacctactacgtcg

SEQ ID NO: 360066 - DNA, 541 bp, Homo sapiens
  misc_feature: GZ8MTXP02H2M6N.38.1.A01.1.454.CMB.2.raw
  modified_base (231)..(231): a, c, t, g, unknown or other
  misc_feature (231)..(231): n is a, c, g, or t
  modified_base (373)..(373): a, c, t, g, unknown or other
  misc_feature (373)..(373): n is a, c, g, or t
  modified_base (405)..(405): a, c, t, g, unknown or other
  misc_feature (405)..(405): n is a, c, g, or t
  modified_base (438)..(438): a, c, t, g, unknown or other
  misc_feature (438)..(438): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccagggggaagacgccaccctctcctgcagggccagtcagagtgttanacactgcctgtaccatcagaacctggccaggctccagactcctcatctatgatgcactcccaacgagggccacgtggtcgtcccagccctaggttcagtcggcaggtgggtctgggacagtcgttcacttcctaccacctancacgcacgcctgactagttcgtagtaacgttntttcgactttagtttattagtttgtacgtagtntaagtatacgattcgacgttcgccttacgactccgtacgtcggacgacggacctacgacgtacgaactaaacgaacgtcgtgtcggactacgacctactatcg

SEQ ID NO: 360067 - DNA, 521 bp, Homo sapiens
  misc_feature: GZ8MTXP02J2MKS.38.1.A01.1.454.CMB.2.raw
  modified_base (195)..(195): a, c, t, g, unknown or other
  misc_feature (195)..(195): n is a, c, g, or t
  modified_base (358)..(358): a, c, t, g, unknown or other
  misc_feature (358)..(358): n is a, c, g, or t
  modified_base (427)..(427): a, c, t, g, unknown or other
  misc_feature (427)..(427): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcttgatgacgcagtctccagcccaccctgtctgtgtctccagggganagagccaccctctcctgcagggccagtcagagtgttagtaacaacctgcctggtaccatcagaacctggccaggctcccagacctcctcatctatgatgcatccaccgagggcccagtggtcgtccccagcccaggttcaggtggcaggtgggtctggggacnggagttcactctcaccatcagcagcctgcagtctgaagtatttgctagtttattattgtcagcagtatnatcagtcggcctcgatcaccgttcggcgacggggaccacggacgtacggaacctaaacgtaaaccgaacgtggtacggctacggacctacctag

SEQ ID NO: 360068 - DNA, 499 bp, Homo sapiens
  misc_feature: GZ8MTXP02GMO22.38.1.A01.1.454.CMB.2.raw
  modified_base (191)..(191): a, c, t, g, unknown or other
  misc_feature (191)..(191): n is a, c, g, or t
  modified_base (202)..(202): a, c, t, g, unknown or other
  misc_feature (202)..(202): n is a, c, g, or t
  modified_base (274)..(274): a, c, t, g, unknown or other
  misc_feature (274)..(274): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccacctntcctgcagggccagtcagagtgtagtaacactgcctgtaccatcagaacctggccaggctcccagacctccncatctatgatgcatccacgaggccactggtctcccagccaggttcagtcggacagtgggtctgggacagcgttcactctcacatcagcagcctgcagtctagagtatttgctagtttatattgtcagtcagtatgatgagtcgctacgtatctaccgttcggaccgtaggggaccacgacgtacggaacaacgtaaacgtaacgtgtacgctacgacactatccg

SEQ ID NO: 360069 - DNA, 546 bp, Homo sapiens
  misc_feature: GZ8MTXP02JS7CK.38.1.A01.1.454.CMB.2.raw
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagtaacacctagcctggtaccatcagaaacctggccaggcctcccagacctcctcatctatgatgcatcccaccgagggccactgggtctcccagccaggttcagtggcaggtggtcngggacagngttcactcncaccatcagcagcctgcagtctagaagtattttgacttagttttaatttagttgtactagtcgtagttatagattcgaggtcggcctccgatccacccgttcggccgagggggaccacggtacgtacgggaaacctaaacgtaaaacgaacgtagtacggtactcgacctaaccgactttccg

SEQ ID NO: 360070 - DNA, 509 bp, Homo sapiens
  misc_feature: GZ8MTXP02F1BBM.38.1.A01.1.454.CMB.2.raw
  modified_base (278)..(278): a, c, t, g, unknown or other
  misc_feature (278)..(278): n is a, c, g, or t
  modified_base (307)..(307): a, c, t, g, unknown or other
  misc_feature (307)..(307): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagtaacactgcctggtaccatcagaacctggccaggctcccagactcctnatctatgatgcatccacaggccatggtcncccagccaggttcagtcgcaggtgggtctgggacagtgttcactctcaccatcagcagcctgcagtctagagtatttgctagtttattattgtcagtctagttatgatcgagtcggcctcgatccgaccgttcggaccgaggggacacggactacggaaactaagtaaaacgaacgtggtacggctacgaccacctattccg

SEQ ID NO: 360071 - DNA, 518 bp, Homo sapiens
  misc_feature: GZ8MTXP02H8DYU.38.1.A01.1.454.CMB.2.raw
  modified_base (192)..(192): a, c, t, g, unknown or other
  misc_feature (192)..(192): n is a, c, g, or t
  modified_base (277)..(277): a, c, t, g, unknown or other
  misc_feature (277)..(277): n is a, c, g, or t
  modified_base (387)..(387): a, c, t, g, unknown or other
  misc_feature (387)..(387): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagaacacctgcctggtaccatcagaacctggccaggctccagactcctnatctatgatgcatcccacagggccacgtggtctcccagccaggttcaggtcggcaggtgggtctgggacagtgttcactctcaccatcagcagcctgcagtctagaagtntttgcttagtttattattgtcagtctagtatgatcagtcggcctcgactactaccgttcggccgaggggacacggactacggaaactaaagtaaaaccgaacgtaggtacgtactacgaccactacttccg

SEQ ID NO: 360072 - DNA, 537 bp, Homo sapiens
  misc_feature: GZ8MTXP02G73HA.38.1.A01.1.454.CMB.2.raw
  modified_base (362)..(362): a, c, t, g, unknown or other
  misc_feature (362)..(362): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagtaacaacctagcctggtaccatcagaaacctggaccaggcctcccagacctcctcatctatgatgcatcccaccgacgggccacgtggtctccccagcctaggttcagtggcagggtgggctggggacnggtacgttcacttcaccaccatcagcacgcctgcagtctagtaagtagtttgacttagtttattattgtacagtctagtatgatcgtagtcgtcctcgatccgtaccgtcggccgtacggggacacggacgtacggaactaaagtaaacgacgtacgtacggctacgacacgtac

SEQ ID NO: 360073 - DNA, 521 bp, Homo sapiens
  misc_feature: GZ8MTXP02JWBA8.38.1.A01.1.454.CMB.2.raw
  modified_base (358)..(358): a, c, t, g, unknown or other
  misc_feature (358)..(358): n is a, c, g, or t
  modified_base (371)..(371): a, c, t, g, unknown or other
  misc_feature (371)..(371): n is a, c, g, or t
  modified_base (518)..(518): a, c, t, g, unknown or other
  misc_feature (518)..(518): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcaaagtgttagtaacaacctagcctggtaccatcagaaacctggccaggctcccagacctcctcatctatgatgcatcccaccagggccacgtggtcgtcccagccaggttcagtcggctagtgggtctgggacagngttcactctcacntcagcagcctgcagtctagaagtattttgactagtttattattgtacagctagttatagatcgagtcggtcctcggatcaccgttcggaccgaggggacacggacgtacggaccaaagtaaaccgaagtgtacggctacgcaacctntcg

SEQ ID NO: 360074 - DNA, 551 bp, Homo sapiens
  misc_feature: GZ8MTXP02F2K32.38.1.A01.1.454.CMB.2.raw
  modified_base (193)..(193): a, c, t, g, unknown or other
  misc_feature (193)..(193): n is a, c, g, or t
  modified_base (225)..(225): a, c, t, g, unknown or other
  misc_feature (225)..(225): n is a, c, g, or t
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaatcgtgatgacgcagtctccagccacctgtctgtgtctccgagggganagacgccaccctctcctgcagggccagtcagngtgttagaacacctgcctggtaccatcagaaacctgccaggcctcccagacctcctcatctatgatcgcactcccacgagggcccagtggtcgtccccagccaggttcaggtgcaggtgggtcagggacnggtcgttcacttccncacatcaagcacgcctagactagtctagtaagttatttgacttagttttattagttgtacagtactagtatacgatcgagtccggccttacgacttccgtaccgttcggaccggaaggggaccacggacgttaacggaactaaaacgtaaaccgtacgtgtacggctacgacctaacgtcg

SEQ ID NO: 360075 - DNA, 588 bp, Homo sapiens
  misc_feature: GZ8MTXP02H1680.38.1.A01.1.454.CMB.2.raw
  modified_base (193)..(193): a, c, t, g, unknown or other
  misc_feature (193)..(193): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
  modified_base (402)..(402): a, c, t, g, unknown or other
  misc_feature (402)..(402): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagagcccaccctctcctgcagggccagtcagagtgttagaacaacctagcctggtaccatcagaaacctggccaggcctcccagacctcctcatctatgatgcatcccacgaggcccagtggtcgtcccagcccaggttcagtggcagtgggtctgggacagngttcattcctnacctancacgcacgcctgctagtcgtagtaagttntttgtacttagtttaatttattgtactagtactagttagtagtattacgtaggtcgtcccgttaccgtacgtacccgtaacccgttccgggaccggtaaacgggggaaccctaacggtaaccgtacggaaaaccgtaaaacgtaaaaccgtaacgtacggtacgtacgtcgaccctacgtacgtcg

SEQ ID NO: 360076 - DNA, 515 bp, Homo sapiens
  misc_feature: GZ8MTXP02HWBJQ.38.1.A01.1.454.CMB.2.raw
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
  modified_base (347)..(347): a, c, t, g, unknown or other
  misc_feature (347)..(347): n is a, c, g, or t
  modified_base (355)..(355): a, c, t, g, unknown or other
  misc_feature (355)..(355): n is a, c, g, or t
  modified_base (358)..(358): a, c, t, g, unknown or other
  misc_feature (358)..(358): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagtaacaacctagcctggtaccatcagaacctggccaggctcccagactccnatctatgatgcatcccacgagggcccatggtctccccagcccaggttccaggtgcaggtgggtntggggacnggnttcactctcaccatcagcagcctgcagtctagaagtatttgactagtttattagttgtacagtctagtatgatcagtcgcctacgatctactcggaccgagggacacgacgtacggaactaaagtaaacgtacgtagtacggactacgactacctag

SEQ ID NO: 360077 - DNA, 496 bp, Homo sapiens
  misc_feature: GZ8MTXP02FMO9Z.38.1.A01.1.454.CMB.2.raw
  modified_base (191)..(191): a, c, t, g, unknown or other
  misc_feature (191)..(191): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacaacctagcctggtaccatcagaacctggccaggctcccagacctcctcatctatgatgcatcccaccagggccactgggtctcccagccaggttcaggtggctaggtgggtctggggacaggtcgttcactctcaccatcagcagcctgcagtctagagtatttgctagtttattattgtacagcagtatgatcagtcgcctcgactcaccgttcggccgagggacacgacgtacgaacaataaacgaagtgcgctgcacatc

SEQ ID NO: 360078 - DNA, 490 bp, Homo sapiens
  misc_feature: GZ8MTXP02JTNEZ.38.1.A01.1.454.CMB.2.raw
  modified_base (281)..(281): a, c, t, g, unknown or other
  misc_feature (281)..(281): n is a, c, g, or t
  modified_base (312)..(312): a, c, t, g, unknown or other
  misc_feature (312)..(312): n is a, c, g, or t
  modified_base (348)..(348): a, c, t, g, unknown or other
  misc_feature (348)..(348): n is a, c, g, or t
  modified_base (369)..(369): a, c, t, g, unknown or other
  misc_feature (369)..(369): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagtaacactagcctggtaccatcagaaacctggccaggctcccagactccncatctatgatgcatccacagggccactggtntcccagccaggttcagtggcagtgggtctggggacnggagttcactctcaccatcancagcctgcagtctgaagtatttgctagtttattattgtcagcagtatgatcagtgcctcgatcaccttcggcgtacgggacacgactacggacaagtaaacgaactagtaggctcgcacta

SEQ ID NO: 360079 - DNA, 572 bp, Homo sapiens
  misc_feature: GZ8MTXP02HYC20.38.1.A01.1.454.CMB.2.raw
  modified_base (191)..(191): a, c, t, g, unknown or other
  misc_feature (191)..(191): n is a, c, g, or t
  modified_base (355)..(355): a, c, t, g, unknown or other
  misc_feature (355)..(355): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacaacctagcctggtaccatcagaaacctggcaggctccagactcctcatctatgatgcatccaccagggcccacgtggtgtccccagccctaggttcagtcggcaggtgggtctggggacagngttcactctcaccatcagcagcctgcagtctagagtatttgtatagtttatttatttagttctagtacgtagtagtagtatacgtagtcggtccgtaccgtaccgtaccgtacccgttaccggtaccggaacggggaaccggaaccgtaaccgtacggtaaacgtaaaacgtaaaacgtaaacgtacggtacggtacgtacgaccgtacctactacg

SEQ ID NO: 360080 - DNA, 525 bp, Homo sapiens
  misc_feature: GZ8MTXP02IHW0L.38.1.A01.1.454.CMB.2.raw
  modified_base (193)..(193): a, c, t, g, unknown or other
  misc_feature (193)..(193): n is a, c, g, or t
  modified_base (280)..(280): a, c, t, g, unknown or other
  misc_feature (280)..(280): n is a, c, g, or t
  modified_base (312)..(312): a, c, t, g, unknown or other
  misc_feature (312)..(312): n is a, c, g, or t
  modified_base (351)..(351): a, c, t, g, unknown or other
  misc_feature (351)..(351): n is a, c, g, or t
  modified_base (371)..(371): a, c, t, g, unknown or other
  misc_feature (371)..(371): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccacctgtctgtgtctccagggganagagccacctctcctgcagggccagtcagagtgttagtaacacctagcctggtaccatcagaaacctggccaggctccagactcctnatctatgatgcatcccacagggccacgtggtntcccagccaggttcagtggcaggtgggtctgggacaggngttcactctcacatcagtancctgcagtctgaagtattttgactagtttattattgtactagtactagttatgaatcgaagtcggcctcgatccgaaccgtttcggaccgaggggacaacggactagggaaacctaagtaaaacgaacgttgacggactaggaccactaactcg

SEQ ID NO: 360081 - DNA, 519 bp, Homo sapiens
  misc_feature: GZ8MTXP02HV1BV.38.1.A01.1.454.CMB.2.raw
  modified_base (194)..(194): a, c, t, g, unknown or other
  misc_feature (194)..(194): n is a, c, g, or t
  modified_base (351)..(351): a, c, t, g, unknown or other
  misc_feature (351)..(351): n is a, c, g, or t
  modified_base (396)..(396): a, c, t, g, unknown or other
  misc_feature (396)..(396): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagcccaccctctcctgcagggccagtcagagtgtagtaacactagcctggtaccatcagaacctggccaggctcccagactctcatctatgatgcatccaccagggccagtggtctccccagccgaggttcagtggcaggtggggtctggggacnggtagttcacgttcctacaccatccagcagcctgcagtctgaatntttgcttagtttattattgtctagctagtatgatcgagtcggtcctcgatccgtaccgttcggaccgacgggacacgacgtacggaacaaagtaaacgtacgtcgtacggactcgactaccta

SEQ ID NO: 360082 - DNA, 565 bp, Homo sapiens
  misc_feature: GZ8MTXP02GM524.38.1.A01.1.454.CMB.2.raw
  modified_base (196)..(196): a, c, t, g, unknown or other
  misc_feature (196)..(196): n is a, c, g, or t
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (458)..(458): a, c, t, g, unknown or other
  misc_feature (458)..(458): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagagcccaccctctcctgcagggccagtcagagtgttagaacactagcctggtaccatcagaaccngccagccnccanctccnatctatgatncatcccacgnggccagtggtctcccagcctaggttcaggtcgctaggtcgggtctaggggaactagggtacgttccaccttcctaccaacctatccgagccgacgtccctgccaagtctaggtaaagttagttttcgattagttttattagttgtactagactagttanagtatcgtaggtcgtacctacgtactccgtaccggtcggaccgtaacgggacacggtacgtacgaaactaaacgtaaacgtacgtacggtacgactacgacctactg

SEQ ID NO: 360083 - DNA, 516 bp, Homo sapiens
  misc_feature: GZ8MTXP02JYMPT.38.1.A01.1.454.CMB.2.raw
  modified_base (192)..(192): a, c, t, g, unknown or other
  misc_feature (192)..(192): n is a, c, g, or t
  modified_base (356)..(356): a, c, t, g, unknown or other
  misc_feature (356)..(356): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagaacacctagcctggtaccatcagaaacctggccaggctcccagacctcctcatctatgatgcatcccacgagggccacgtgggtcgtcccagcctaggttcaggtcggcagtgggtctgggacagngttcactctcaccatcagcagcctgcagtctagaagtctttgcttagtttattattgtcagtcagtatgatcgagtcggctccgatcaccgttcggaccgtaggggacacgacgtacggaacaaacgtaaacgaacgtcgtacggactagccactactcg

SEQ ID NO: 360084 - DNA, 579 bp, Homo sapiens
  misc_feature: GZ8MTXP02HYQZ3.38.1.A01.1.454.CMB.2.raw
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgccaccctctcctgcagggccagtcagagtgttagtaacactagcctgtaccatcaagaaacctggaccaggcctcccagacctcctcatctatgatgcactccacgagggccagtggtctccagcctaggtcaggtggctaggtgggtcngggacnggtagttcacgttcaccaccatcagcagccctgcagtctagaagttatttgactttaagtttatttagttgtactagtagtaggttataggtacttacgtacggttcggtacccttaccggacttacccgtacccggtttccgggaccggtaacggggaccaacggaacgtacggaaaccaaaaggtaaaccgaacgttggacggactacggacctacctacg

SEQ ID NO: 360085 - DNA, 513 bp, Homo sapiens
  misc_feature: GZ8MTXP02F8VC8.38.1.A01.1.454.CMB.2.raw
  modified_base (317)..(317): a, c, t, g, unknown or other
  misc_feature (317)..(317): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagtaacacctagcctggtaccatcagaacctggccaggcctcccagacctcctcatctatgatgcatcccaccagggccacgtgggtcncccagccaggttcaggtggcaggtgggtctggggacaggtgttcacttctccaccatcagcagcctgcagtctagagtatttgcttagtttattattgtacagtctagttatgactgagtcggcctcgatccaccgttcggaccgaggggaccacgacgtaggaacaagtaaacgaacgtggcgactgacacagtc

SEQ ID NO: 360086 - DNA, 701 bp, Homo sapiens
  misc_feature: GZ8MTXP02IDZ6G.38.1.A01.1.454.CMB.2.raw
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctcggagggagagcgccacctctcctgcgacggccagtcaggtagttagttaacgaaacctaaccgtacgtccgtacggtaacctactacgaaaacgtaaaccgtcggacccgacggtcccctacccgacgtacccttccctacacttactagtagatcgactactaccccaaccggacggacctacgttcgggtcctacccgacgtaccgtaggttacgaggtccggacgtagggttcggtcggtagggaacaggttcgttccacttcctaccacctatcgacgacacgccctgacgtacgtcttaaggaagttttagttttcggaacttttaagttttaatttagtttaccggtatacggtactaagtttagagtacgttacgtaggtccggtacccttacgtacttaccgtacccggttccggaaccgggtacgggaccctaacggtacgtacggaaaacctaaaacgtaaaaccggtgtttacggacgtccgtaacgaccctaaacgtacgtttccg

SEQ ID NO: 360087 - DNA, 486 bp, Homo sapiens
  misc_feature: GZ8MTXP02JGZIK.38.1.A01.1.454.CMB.2.raw
  modified_base (191)..(191): a, c, t, g, unknown or other
  misc_feature (191)..(191): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagaacacctagcctggtaccatcagaaacctggccaggctcccagactcctcatctatgatgcatcccaccgagggccatgggtctcccagccaggttcagtcggcagtggtctggggacngtgttcactcncaccatcancagcctgcngtctagagtattttgctagtttattattgtcagtcagtatgatcgagtcgctcgatcgacttcggcagggacacgactcggacaagtaacgaagtgtacgctgcacatc

SEQ ID NO: 360088 - DNA, 495 bp, Homo sapiens
  misc_feature: GZ8MTXP02HDH2C.38.1.A01.1.454.CMB.2.raw
  modified_base (192)..(192): a, c, t, g, unknown or other
  misc_feature (192)..(192): n is a, c, g, or t
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (404)..(404): a, c, t, g, unknown or other
  misc_feature (404)..(404): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctccagaaatcactggagaaatcgtgatgacgcagtctccagccaccctgtctgtgtctcagggganagacgccaccctctcctgcagggccagtcagagtgtataacaactgcctgacatcagaaccngcagcnccanctcnatctatgatncanccacgaggccagtggtcncccagccaggttcagtgcagtgggtctggggacaggtacttcactctacacatccagcagcctgcagtcagaagtatttgatagtttatattgtcagcagtatanatcgagtcgcctacgtactcctaccgtcggacgaacgggacaacggacgtacgaaacaaagtaaaacgacgtggtacgcacgacctactcg

SEQ ID NO: 360089 - DNA, 519 bp, Homo sapiens
  misc_feature: GZ8MTXP02GZ24G.38.1.A01.1.454.CMB.2.raw
  modified_base (191)..(191): a, c, t, g, unknown or other
  misc_feature (191)..(191): n is a, c, g, or t
  modified_base (203)..(203): a, c, t, g, unknown or other
  misc_feature (203)..(203): n is a, c, g, or t
  modified_base (353)..(353): a, c, t, g, unknown or other
  misc_feature (353)..(353): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctntcctgcagggccagtcagagtgttagtaacaacctagcctggtaccatcagaaacctggccaggctcccagacctcctcatctatgatgcatcccaccgaggccacgtggtctcccagcccaggttcagtcggcaggtggctgggacagngttcactctacacatcagcagcctgcagtctagaagtattttgactagtttattagttgtacagtcagtatgattcgagtgaccttcgatcaccgttcggccgtagggacacgacgtacggaacctaaagtaaacgaacgtggtacggactcgactacccattccg

SEQ ID NO: 360090 - DNA, 526 bp, Homo sapiens
  misc_feature: GZ8MTXP02J1OOM.38.1.A01.1.454.CMB.2.raw
  modified_base (194)..(194): a, c, t, g, unknown or other
  misc_feature (194)..(194): n is a, c, g, or t
  modified_base (351)..(351): a, c, t, g, unknown or other
  misc_feature (351)..(351): n is a, c, g, or t
  modified_base (386)..(386): a, c, t, g, unknown or other
  misc_feature (386)..(386): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagcccaccctctcctgcagggccagtcagagtgttagtaacactagcctggtaccatcagaacctggccaggctcccagactcctcatctatgatgcatccacagggccagtggtctcccagccaggttcaggtggcaggtcgggtctggggacnggacgttcactctcaccatcagcagcctgcagtcngaagtattttgactagtttattattgacagtcaggtatgattcgaggttcggcccttcgattccaccgttcgggaccacgggggaccacgacgtaggaaccaaaagtaaaccgaacgttggacggtactcgaccacctag

SEQ ID NO: 360091 - DNA, 549 bp, Homo sapiens
  misc_feature: GZ8MTXP02IWVBS.38.1.A01.1.454.CMB.2.raw
  modified_base (191)..(191): a, c, t, g, unknown or other
  misc_feature (191)..(191): n is a, c, g, or t
  modified_base (203)..(203): a, c, t, g, unknown or other
  misc_feature (203)..(203): n is a, c, g, or t
  modified_base (311)..(311): a, c, t, g, unknown or other
  misc_feature (311)..(311): n is a, c, g, or t
  modified_base (355)..(355): a, c, t, g, unknown or other
  misc_feature (355)..(355): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctntcctgcagggccagtcagagtgttagtaacacctagcctggtaccatcagaaacctggccaggctcccagactcctcatctatgatgcatccaccagggccactggtntcccagccaggtttacgagtggactaggtgggtcgtaggacagngttcactctccaccatcancgacncngnagtntagattagtttagacttagtttatttagttcgtactagtacttagtatagtactacgtaggtcgtcctacgtactccgtacccgtcggaccggaacgggaccacgtaacgtacgaaaacgtaaacgtaaaacgaacgtggtacgactacgacctactactcg

SEQ ID NO: 360092 - DNA, 564 bp, Homo sapiens
  misc_feature: GZ8MTXP02I5ITG.38.1.A01.1.454.CMB.2.raw
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagtaacacctagcctggtaccatcagaacctggccaggctcccagactcctcatctatgatgcatcccaccagggccacgtggtcgtcccagccctaggttcagtcggcaggtgggtctgggacngngtcactcncacatccagcagcctgacagtctagtaatattttgactagtttattattgtacagtctagtatgattcgaggttcggacccttcgaacttccgacccgtttcgggaccgaacgggggacctacgggaccttaggggaaaacccaaaagttaaaaccggaacgttacggtacgggaccttacggacccaaccgtaatttcccg

SEQ ID NO: 360093 - DNA, 594 bp, Homo sapiens
  misc_feature: GZ8MTXP02JLYR0.38.1.A01.1.454.CMB.2.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (369)..(369): a, c, t, g, unknown or other
  misc_feature (369)..(369): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgcccaccctctcctgcagggccagtcagagtgtagaacactgcctgtaccatcagaacctgccaggcctccagacctccnatctatgatcgcactcccaccgngggccacgtggtctccccagtcccgtaggttccagggtcggactagggtcggggtcgtaggggacnggtacgttccacgtcctaccaaccatcgacgcgacgtccctgactagttctaggtaacgttagttttgacgtttaagttttattacgttgtacgtagtacgtaggtataggtaactcgtacggtcggtcccttaccgacttcccgtaccggttccggaccggacggggtaccacggtacgtacggaacaaacgtaaacgacgtggtacgactcgacctacgtacg

SEQ ID NO: 360094 - DNA, 588 bp, Homo sapiens
  misc_feature: GZ8MTXP02FR6PF.38.1.A01.1.454.CMB.2.raw
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcagggccagtcagagtgttaagtaacaacctagcctggtaccatcaagaaacctggccaggcctcccagacctcctcatctatgatgcatcccaccgagggccacgtggtcgtcccagccaggttcaggtcggcaggtgggtctggggacaggtgttcactctcaccatcagcagcctgcagtctagaagtatttgacttagtttattagttgtactaggtctagttatagtatcgtaaggttcgggcccttccggtaatccccgtaacccgtttccgggacccggaagggggaccaaaccggacgttacgggaaaacctaaaacgttaaaacggaaccgttaggtacgggtaccgtcggaccaacccgtagtttccg

SEQ ID NO: 360095 - DNA, 503 bp, Homo sapiens
  misc_feature: GZ8MTXP02I5GZT.38.1.A01.1.454.CMB.2.raw
  modified_base (349)..(349): a, c, t, g, unknown or other
  misc_feature (349)..(349): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagtaacacctagcctggtaccatcagaaacctggccaggctcccagactcctcatctatgatgcatcccacagggccacgtggtctcccagccaggttcagtcgcagtgggtctgggacagngttcactctcaccatcagcagcctgcagtctagagtatttgactagtttattattgtcagtctagtatgatcagtcggcctcgatcgaccgttcggaccgaggggaccacgactacggaacaacgtaaacgaacgtgtacgactcgacacatcg

SEQ ID NO: 360096 - DNA, 550 bp, Homo sapiens
  misc_feature: GZ8MTXP02FU6WX.38.1.A01.1.454.CMB.2.raw
  modified_base (284)..(284): a, c, t, g, unknown or other
  misc_feature (284)..(284): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcagggccagtcagagtgttagaacactagcctggtaccatcagaacctggccaggctccagactcctcatctangatgcactccaccgagggccacgtgggtctcccagcctaggttccaggtcggcgtagggtgggtctggggaacaggtcgttcacgtctaccaccatccagcagcctgcagtctagaagtatttgacttagtttattattcgtactaggtctaagttatgacgtcgagtcggacctccgaactccgtaccgttcgggaccgagggggacaacggacgtacggaaactaaagtaaaacgaacgtggacggtctaggaccacgtacttc

SEQ ID NO: 360097 - DNA, 503 bp, Homo sapiens
  misc_feature: GZ8MTXP02G5YC1.38.1.A01.1.454.CMB.2.raw
  modified_base (195)..(195): a, c, t, g, unknown or other
  misc_feature (195)..(195): n is a, c, g, or t
  modified_base (318)..(318): a, c, t, g, unknown or other
  misc_feature (318)..(318): n is a, c, g, or t
  modified_base (353)..(353): a, c, t, g, unknown or other
  misc_feature (353)..(353): n is a, c, g, or t
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagtaacaacctagcctggtaccatcagaacctggccaggctcccagactcctcatctatgatgcactcccacagggccacgtggtcncccagccaggttcagtgctaggtgggctggggacngagttcactctcaccatcagcagcctgcagtcngaagtnttttgactagtttattattgtcagcagtatgatcagtcgctcgatcacgtcgcgacgggacacggacgtacgaacaaacgtaaacgtaacgtggtacgctacgacctacta

SEQ ID NO: 360098 - DNA, 506 bp, Homo sapiens
  misc_feature: GZ8MTXP02FOJ2M.38.1.A01.1.454.CMB.2.raw
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagtaacacctagcctggtaccatcagaacctggccaggctcccagactcctcatctatgatgcatcccaccagggccactggtcgtcccagccaggttcagtggcagtgggtctgggacagngttcactcncaccatcagcagcctgcagtctagaagtattttgctagtttattattgtcagctagtatgatcgagtcggcctccgactccgaccgttccggaccgacgggggacacggactacggaacaagtaaacgaacgtgtaggctgcacatcg

SEQ ID NO: 360099 - DNA, 531 bp, Homo sapiens
  misc_feature: GZ8MTXP02IPML4.38.1.A01.1.454.CMB.2.raw
  modified_base (192)..(192): a, c, t, g, unknown or other
  misc_feature (192)..(192): n is a, c, g, or t
  modified_base (274)..(274): a, c, t, g, unknown or other
  misc_feature (274)..(274): n is a, c, g, or t
  modified_base (353)..(353): a, c, t, g, unknown or other
  misc_feature (353)..(353): n is a, c, g, or t
  modified_base (396)..(396): a, c, t, g, unknown or other
  misc_feature (396)..(396): n is a, c, g, or t
  modified_base (517)..(517): a, c, t, g, unknown or other
  misc_feature (517)..(517): n is a, c, g, or t
tcagtcgatcacgtcacgaccggtgctcgatttagacgtctcatcagggggaactgctcagttaggacccagacggaaccatggaagccccagcgcagcttctcttccctcctgatactctggctcccagaaatcactggagaaatcgtgatgacgcagtctccagccaccctgtctgtgtctccagggganagacgcccacccctctcctgcagggccagtcagagtgttagtaacacctagcctggtaccatcagaacctggcaggctccanctcctcatctatgatgcatccaccagggccacgtggtctcccagcctaggttcaggtcgcaggtgggtctgggacaggngttccactcctcaccatcagcacgcctgcagtctagtaagttntttgacttagttttaattattgtactagtcagttactgatcgtagtcgcctcgatccgaccgttcggaccgtaggggaccacggactacggaaacctaagtaaaaccgaacgtgtacggcncgacaccgtatccg

SEQ ID NO: 360100 - DNA, 594 bp, Homo sapiens
  misc_feature: GZ8MTXP02F1STV.38.1.A01.1.454.CMB.2.raw
  modified_base (286)..(286): a, c, t, g, unknown or other
  misc_feature (286)..(286): n is a, c, g, or t
tcagtcgatcacgtcacgaccggtgctcgatttagacgtctcatcagggggaactgctcagttaggacccagacggaaccatggaagccccagcgcagcttctcttcctcctgatactctggcctccaagaaatcactggaagaaatcgtgatgacgcagtctccagccaccctgtctgtgtctccgaggggagagacgcccaccctctcctgcagggccagtcagagtgttaagaacaactgcctggtaccatcaagaacctggccaggcctcccagtacctccnatctatgatgccactcccaaccgacgggcccacggttgggtctccccagcccgaggttcaggtcggcagggtggtcgtagggactaggtcgttccacgttcaccacctatccgagccacgcccgtgaccgtagttcgtaggtaaagttagttttacgtactttaagttttaatttagtttacgttacgtaacgtatagttatagtacgtacgtacggtcgtaccgtacgtactccgtaccgtcggaccgacgggactacggacgtacgaaacaaacgtaacgaacgtcggacgctagacctactctcg

SEQ ID NO: 360101 - DNA, 516 bp, Homo sapiens
  misc_feature: GZ8MTXP02J2PH1.38.1.A01.1.454.CMB.2.raw
  modified_base (193)..(193): a, c, t, g, unknown or other
  misc_feature (193)..(193): n is a, c, g, or t
  modified_base (394)..(394): a, c, t, g, unknown or other
  misc_feature (394)..(394): n is a, c, g, or t
  modified_base (407)..(407): a, c, t, g, unknown or other
  misc_feature (407)..(407): n is a, c, g, or t
  modified_base (418)..(418): a, c, t, g, unknown or other
  misc_feature (418)..(418): n is a, c, g, or t
  modified_base (438)..(438): a, c, t, g, unknown or other
  misc_feature (438)..(438): n is a, c, g, or t
  modified_base (465)..(465): a, c, t, g, unknown or other
  misc_feature (465)..(465): n is a, c, g, or t
  modified_base (491)..(491): a, c, t, g, unknown or other
  misc_feature (491)..(491): n is a, c, g, or t
  modified_base (513)..(513): a, c, t, g, unknown or other
  misc_feature (513)..(513): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagagcccaccctctcctgcagggccagtcagagtgttagaacactagcctggtaccatcagaacctggccaggcctccagactcctcatctatgatgcactccaccgacgggccacgtggtcgtcccgagcctaggttcaggtggctaggtcgggtctgggacagtcgtcactctcaccatcagcagcctgcagtcagatntttgcttagtttntattgtcagtntagtatgatcgtagcgtccncgtatccgacgttcggaccgagggacncgacgtacgaacctaaagtaaaccgngtcggtacgctacgactacctntcg

SEQ ID NO: 360102 - DNA, 480 bp, Homo sapiens
  misc_feature: GZ8MTXP02J0WJC.38.1.A01.1.454.CMB.2.raw
  modified_base (312)..(312): a, c, t, g, unknown or other
  misc_feature (312)..(312): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (407)..(407): a, c, t, g, unknown or other
  misc_feature (407)..(407): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagaacaacctagcctggtaccatcagaaacctggccaggctcccagacctcctcatctatgatgcatccaccagggccactggtntcccagccaggtcagtgcagtgggtctgggacagngttcactctnaccatcagcagcctgcagtctgaagattttgctagtttattattgtcagnagtatgatcgagtcgcctcgatcacttcggccaggggacacgactgacaaataacgaacgtgagctgcacatc

SEQ ID NO: 360103 - DNA, 540 bp, Homo sapiens
  misc_feature: GZ8MTXP02GFMXY.38.1.A01.1.454.CMB.2.raw
  modified_base (350)..(350): a, c, t, g, unknown or other
  misc_feature (350)..(350): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagcccaccctctcctgcagggccagtcagagtgttagaacaacctagcctggtaccatcagaaacctggccaggctcccagactcctcatctatgatgcatcccacagggccacgtggtctcccagccaggttcagtgcagtgggtctgggacngtagttcactctcacatcagcagcctgcagtctagaattgttttgacttaagttttaattagttgtactagtctaagtatagtatcgaggtcgccctacgtacttcccgtaccgttccggaccgtacgggggacctaccggacgtacgaactaaaagtaaacgaacgtggtacggactcgaccaccgtag

SEQ ID NO: 360104 - DNA, 506 bp, Homo sapiens
  misc_feature: GZ8MTXP02ICNVW.38.1.A01.1.454.CMB.2.raw
  modified_base (187)..(187): a, c, t, g, unknown or other
  misc_feature (187)..(187): n is a, c, g, or t
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccacctgtctgtgtctcagggnagagccacctntccngcagggccagtcagagtgtagaacactagcctggtaccatcagaacctggccaggctcccagactcctcatctatgatgcatcccaccngggccactggtctcccagccaggttcaggtcgcaggtggtctggggacagtgttccactctcaccatcagccagccctgacagtctagaagtatttgctagtttattatttgtcagtctagtatgatcagtcggactcgatccgtaccttcgggacctaggggacacggtactggaacctaagaaacgaacgttgacgactagaccaactactcg

SEQ ID NO: 360105 - DNA, 539 bp, Homo sapiens
  misc_feature: GZ8MTXP02FSCGF.38.1.A01.1.454.CMB.2.raw
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagcccaccctctcctgcagggccagtcagagtgttagtaacacctagcctggtaccatcagaacctggccaggctcccagactcctcatctatgatgcactcccaccgagggcccagttcgggtctccccagcccagggttccaggtcggctaggtggggtctggggaacaggtacgttccacttcctccaacctatccagcacgcctgcagtctagaagtatttgctagtttattattgtacagtctagtatgatcgagtcggcctcgactctaccgttcggaccgaggggaccacggacgtacggaacaagtaaacgaacgtgacggtctcgacaccgtatcg

SEQ ID NO: 360106 - DNA, 645 bp, Homo sapiens
  misc_feature: GZ8MTXP02JEC7K.38.1.A01.1.454.CMB.2.raw
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccacctgtctgtgtctccgaggggagagacgccaccctctcctgcgagggccagtcagagtgttaagtaacactagcctggtaccatcagaacctggccaggcctccagacctcctcatctatgatgcatccacgaggccagtggtctacccagcctaggttcagtcggcaggtcgggtcgtgggacaggtacgttccaactcctaccactatccagcacgccgtgacgtagttcgtagtaacgttagtttttacgacgttagtttttattagtttaggtaccaaggtctaaggttagtagtaaattcgaagggttcggtaccccgttaccgtaacgtttccccgtaaacccggtttccggggaccgaaaccgggggtaaacccaacggtaaaccgggttacggaaaaaccgtaaaacgttaaaaccggtaagtttcgggaaccggtaccgttacgaaccctaaacccgttatttaccg

SEQ ID NO: 360107 - DNA, 523 bp, Homo sapiens
  misc_feature: GZ8MTXP02G0DYG.38.1.A01.1.454.CMB.2.raw
  modified_base (433)..(433): a, c, t, g, unknown or other
  misc_feature (433)..(433): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagtaacaacctagcctggtaccatcagaaacctggaccaggctcccagactcctcatctatgatgcatccacagggccactggtcgtccccagccaggttcaggtggctaggtgggtctggggacaggagttcactctacacatcagccagtcctagcagtctagaagtatttgatagtttattattgtcagtcgaagttanagtatcgtagtcggcctcgattccgaccgttcggaccgcggggacacgactaggaaccaaagtaaacgaactggtacggctagccactag

SEQ ID NO: 360108 - DNA, 478 bp, Homo sapiens
  misc_feature: GZ8MTXP02F5K0B.38.1.A01.1.454.CMB.2.raw
  modified_base (346)..(346): a, c, t, g, unknown or other
  misc_feature (346)..(346): n is a, c, g, or t
tcagtcgatcacgtcacgaccggtgctcgatttagacgtctcatcaggggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccacctctcctgcagggccagtcagagtgttagaacaacctagcctggtaccatcagaacctggccaggctcccagactcctcatctatgatgcatccaccagggccactggtgtccccagccaggttcagtcgcagtgggtctgggacagngttcactctcaccatcagcagccctgcagtctgaagtattttgctagtttattattgtcagcagtatgatcagtgctcgatcacttcgccagggacacgactgaacaataaacgaactgtcgctgcaccatc

SEQ ID NO: 360109 - DNA, 648 bp, Homo sapiens
  misc_feature: GZ8MTXP02H6K2T.38.1.A01.1.454.CMB.2.raw
  modified_base (193)..(193): a, c, t, g, unknown or other
  misc_feature (193)..(193): n is a, c, g, or t
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
tcagtcgatcacgtcacgaccggtgctcgatttagacgtctcatcagggggagaactgctcagttaggacccagacggaaccatggaagccccagcgcagcttctcttcctcctgatactctggctcccagaaatcactggagaaatcgtgatgacgcagtctccagccaccctgtctgtgtctccagggganagacgccaccctctcctgccagggccagtcagagtgttagtaacaactagcctggaccatcagaaccngccaggctcccanacctctcatctangatgcactcccacgagggccagtggtcgtcccagccgtaggttcaggtggactaggtcggggtctaggggactggtacgtttcacgttcaccaccgatcacgcacgcctgacagttctagtaagtattttgacttaagtttatttagttgtacttagtctaagttagttagaacttcggtaacggttccggtaacccttcggtaacccttaccccgttaaacccggtttacccggggaccccggggtaaacggggtaaacccggaaccggttaaaccggtaaacgggaaaccttaaaaaccggtaaaaccggtaaccggttacggtacgggtacccttacggaaccctacccgtttaaacg

SEQ ID NO: 360110 - DNA, 536 bp, Homo sapiens
  misc_feature: GZ8MTXP02JGWYJ.38.1.A01.1.454.CMB.2.raw
  modified_base (358)..(358): a, c, t, g, unknown or other
  misc_feature (358)..(358): n is a, c, g, or t
  modified_base (405)..(405): a, c, t, g, unknown or other
  misc_feature (405)..(405): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagcccaccctctcctgcagggccagtcagagtgttagtaacactagcctggtaccatcagaaacctggccaggcctacccagactcctcatctatgatcgcatcccacgagggccacgtggtcgtcccagccaggttcaggtgcaggtgggtctggggaacnggtcgttcaccgtcactaccgatcacgcagcctgcagtctagaattntttgacttagtttattattgtacagtctagtatgatcgagtcgcctacgatcctaccgttcggaccgaacggggactaacggacgtacggaacaaaacgtaacggaactggtacgcgtcgacctacgtacg

SEQ ID NO: 360111 - DNA, 529 bp, Homo sapiens
  misc_feature: GZ8MTXP02JOBAZ.38.1.A01.1.454.CMB.2.raw
  modified_base (192)..(192): a, c, t, g, unknown or other
  misc_feature (192)..(192): n is a, c, g, or t
  modified_base (280)..(280): a, c, t, g, unknown or other
  misc_feature (280)..(280): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttaagaacactagcctggtaccatcagaacctggccaggctcccagacctcctnatctatgatgcatcccacgaggccagtggtctcccagcctaggttcaggtcggcaggtcgggtctgggacagtcgttcactcacaccatcagcagcctgctagtctagtagtatttgacttagtttattagttgtacagtctagttactagtatcgagtcggcctcgactctaccgtcggacgaggggtaccacgacgtacggaactaaacgtaacgaactcggtacggactagacctacgacttaccg

SEQ ID NO: 360112 - DNA, 563 bp, Homo sapiens
  misc_feature: GZ8MTXP02JQHGA.38.1.A01.1.454.CMB.2.raw
  modified_base (193)..(193): a, c, t, g, unknown or other
  misc_feature (193)..(193): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcgagggccagtcagagtgttaagaacactgcctggtaccatcagaacctggccaggcctccagacctcctcatctatgatgcatcccaccgaggccatcggtctcccagcccgaggttcaggtcggactagggtcgggtctggggaccagggtacgtttccaacgttcctaccaccgtaatccagccagcctgacagttctagtaagttatttttgacttaagtttattagttgttacaggtctaagttgtagataccgagtcggcctacgactccgtaccgttccgggaccgaggggaccaggacgtacggaactaaagtaacgaacgtggtacgcgtacgaccacgtatcg

SEQ ID NO: 360113 - DNA, 544 bp, Homo sapiens
  misc_feature: GZ8MTXP02HHNPC.38.1.A01.1.454.CMB.2.raw
  modified_base (192)..(192): a, c, t, g, unknown or other
  misc_feature (192)..(192): n is a, c, g, or t
  modified_base (318)..(318): a, c, t, g, unknown or other
  misc_feature (318)..(318): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcagggccagtcagagtgttagtaacaacctagcctggaccatcagaacctggccaggcctccagactcctcatctatgatgcactcccaaccgagggccagtgggtcncccagcctaggtcaggtcggcaggtgggtctggggacaggngttcactcncaccatcagcagcctgcagtctagagtattttgacttagtttattattggtacagtactagtatgtatcgagtcggtcctaccgatccgtaccgttaccggccgaagggggtacaccgacgtcggaaaacaaagtaaaaccgaacgtaggtcggactacgacctaaccgtattccg

SEQ ID NO: 360114 - DNA, 565 bp, Homo sapiens
  misc_feature: GZ8MTXP02GDXHM.38.1.A01.1.454.CMB.2.raw
  modified_base (205)..(205): a, c, t, g, unknown or other
  misc_feature (205)..(205): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccacccctntcctgcagggccagtcagagtgttaagtaacaacctagcctaggtaccatcaagaaacctggacccaggcctcccagacctcctcatctatgatgcatcccacaggccatggtctcccagcctaggttcaggtcggctaggtgggtctggggacaggtcgttcacttctccaccagtcagcacgcctgctagtcgtagaagttattttcgacttagtttattagtttgtacagtctagttatagtagtcgtagtcggtcctacgatccgtaccgttcggacggtacggggacctacgtacgtacggaaaacctaaacgtaaaaccgaacgttacggtcgtacgtcgaccacctactttcg

SEQ ID NO: 360115 - DNA, 556 bp, Homo sapiens
  misc_feature: GZ8MTXP02IVWG7.38.1.A01.1.454.CMB.2.raw
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
  modified_base (357)..(357): a, c, t, g, unknown or other
  misc_feature (357)..(357): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagtaacactagcctggtaccatcagaacctggccaggctcccagacctcctnatctatgatgcactcccacgagggcccacgtggtctccccagcccaggttcaggtgctaggtgggtctgggacnggtcgttcacttcctaccacatccacgcacgcctcgctagtcgtagtaagtatttagtactagtttattatttgtacgtagtactagtatagtatacgtagtcggtcctaccgggggtactcgtaccgttcggtccgacgggacgacgacgtacgaacgtaaacgtaaacgtaacgtacgtacggacgtacgacactac

SEQ ID NO: 360116 - DNA, 522 bp, Homo sapiens
  misc_feature: GZ8MTXP02IXW79.38.1.A01.1.454.CMB.2.raw
  modified_base (356)..(356): a, c, t, g, unknown or other
  misc_feature (356)..(356): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccacctgtctgtgtctccgaggggagagagccaccctctcctgcagggccagtcagagtgttaagtaacacctagcctggtaccatcagaacctggccaggctccagactcctcatctatgatgcatcccaccgagggccacgtggtctcccagcctaggttcaggtcggctaggtgggtctgggacagngttcactctcaccatcagcagcctgcagtctagacgtatttgactagtttattattgtacagtcagttatgatcgagtgaccctcgactctaccgttcggacgtaacggggacacgacgtacggaaaccaaagtaaacgaacgtgtacggtactgaccactactcg

SEQ ID NO: 360117 - DNA, 588 bp, Homo sapiens
  misc_feature: GZ8MTXP02FKS6X.38.1.A01.1.454.CMB.2.raw
  modified_base (319)..(319): a, c, t, g, unknown or other
  misc_feature (319)..(319): n is a, c, g, or t
  modified_base (415)..(415): a, c, t, g, unknown or other
  misc_feature (415)..(415): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccacccctctcctgcagggccagtcagagtgttaagaacaacctagcctggtaccatcaagaacctggccaggctcccagacctcctcatctatgatgcatcccacagggccatgggtcncccagccaggttcaggtcgcaggtgggtctggggacaggtcgttccacttccgtccaacctatccagcacgtccctgacctagtcctagaaagttnttttaggcttaagttttattagttgtctaggtctaagttagtagtaactcgtaggtcggtaccctacgactccgtaccgttcggaccggtaagggggacctaacggacgtacggaaaacctaaagttaaaaccgaacgttgggtacggtccttacggacctaccgtatttccg

SEQ ID NO: 360118 - DNA, 535 bp, Homo sapiens
  misc_feature: GZ8MTXP02GQPFJ.38.1.A01.1.454.CMB.2.raw
  modified_base (359)..(359): a, c, t, g, unknown or other
  misc_feature (359)..(359): n is a, c, g, or t
  modified_base (402)..(402): a, c, t, g, unknown or other
  misc_feature (402)..(402): n is a, c, g, or t
  modified_base (429)..(429): a, c, t, g, unknown or other
  misc_feature (429)..(429): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagtaacacctagcctggtaccatcagaacctggccaggcctcccagacctcctcatctatgatgcatcccacgagggccacgtggtctcccagccaggttcacggtggcaggtcggggtctggggacnggtacgttcactctccaccatcagcacgctgcagtcagaattntttgatagtttattatgtcagctagtntgatcaggtcgcctacgactccgtaccgttcggaccgtacggggaccacggtaccgtaggaactaaaacgtaaaccggaagttggtacggcctaggacctacctag

SEQ ID NO: 360119 - DNA, 504 bp, Homo sapiens
  misc_feature: GZ8MTXP02IT85U.38.1.A01.1.454.CMB.2.raw
  modified_base (283)..(283): a, c, t, g, unknown or other
  misc_feature (283)..(283): n is a, c, g, or t
  modified_base (351)..(351): a, c, t, g, unknown or other
  misc_feature (351)..(351): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagtaacaacctagcctggtaccatcagaacctggccaggctcccagactcctnatctatgatgcatccacagggccacgtggtctcccagccaggttcagtgcaggtggggtctggggacngtagttcacgtctcaccatcagcagcctgcagtctgaagtatttgactagtttattattgtcagctagtatgatcagtcgtcctcgatcaccgttcggcgacggggacacggactacggaaccaaagtaacgaactgtcggactcgacactac

SEQ ID NO: 360120 - DNA, 544 bp, Homo sapiens
  misc_feature: GZ8MTXP02GWCUU.38.1.A01.1.454.CMB.2.raw
  modified_base (195)..(195): a, c, t, g, unknown or other
  misc_feature (195)..(195): n is a, c, g, or t
  modified_base (362)..(362): a, c, t, g, unknown or other
  misc_feature (362)..(362): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagaacaacctgcctggtaccatcagaacctggccagctcccagactcctcatctatgatgcactcccgaccgacgggccacgtggtcgtccccagccaggttcaggtggctaggtggggtcgtagggacnggtgttcacctctccacatcagcacgcctgcagtctagaagtattttgacttagttttattattcgtctagctaaggtatagattacgtaggtcggcccttaccgtatcctaccgttcggaccggacggggacacgtacgtacggaactaaagtaaacgaacgtgacggactcgaccactag

SEQ ID NO: 360121 - DNA, 526 bp, Homo sapiens
  misc_feature: GZ8MTXP02I6YBR.38.1.A01.1.454.CMB.2.raw
  modified_base (192)..(192): a, c, t, g, unknown or other
  misc_feature (192)..(192): n is a, c, g, or t
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagtaacacctagcctggtaccatcagaacctggccaggctcccagactcctcatctatgatgcatcccacaggccacgtggtctcccagcctaggttcaggtcgcagtgggtctggggacngngttcactctcaccatcagcagcctgcagtctagaagtatttgctagtttattattgtcagtctaatatagatcgaggtcggtcctcgtatccgtaccgttcggaccgtaggggaccaacggtactacggaactaaagtaaacgtaacgtggtacggctacgacctacgtacttcg

SEQ ID NO: 360122 - DNA, 511 bp, Homo sapiens
  misc_feature: GZ8MTXP02F1VFV.38.1.A01.1.454.CMB.2.raw
  modified_base (193)..(193): a, c, t, g, unknown or other
  misc_feature (193)..(193): n is a, c, g, or t
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (505)..(505): a, c, t, g, unknown or other
  misc_feature (505)..(505): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttaagtaacacctagcctggtacccatcagaaacctggccaggctcccagacctcctnatctatgatgcatccaccaggccatggtcnccagccaggttcaggtcgcagtggtctggacngngtcactcncacctatcagcagcctgcagtctagatatttgacttagtttattattcgtntagtntagtatagtatcgagtcggtcctcgatccgtacgtcggcgaggggaccaagacgtagaaccaaagtaaacgaacgtgtacgctcgactacntttccg

SEQ ID NO: 360123 - DNA, 530 bp, Homo sapiens
  misc_feature: GZ8MTXP02HNF7H.38.1.A01.1.454.CMB.2.raw
  modified_base (195)..(195): a, c, t, g, unknown or other
  misc_feature (195)..(195): n is a, c, g, or t
  modified_base (358)..(358): a, c, t, g, unknown or other
  misc_feature (358)..(358): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagtaacaacctagcctggtaccatcagaacctggccaggcctcccagacctcctcatctatgatcgcatcccacgagggccacgtggctcccagccaggttcagtggcaggtcgggtctggggacnggtacgttcacttcctacaccatccagcacgcctggcagtctagaattcttttgacttagtttattatttgactagctagtatgatcagtcgcctcgatccgtacgtcggacgacggggacacggtacgacggaacaaagtaaacgtactggtacgactacgactacgtacg

SEQ ID NO: 360124 - DNA, 640 bp, Homo sapiens
  misc_feature: GZ8MTXP02JYYMI.38.1.A01.1.454.CMB.2.raw
  modified_base (193)..(193): a, c, t, g, unknown or other
  misc_feature (193)..(193): n is a, c, g, or t
  modified_base (283)..(283): a, c, t, g, unknown or other
  misc_feature (283)..(283): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcagggccagtcagagtgttaagtaacactagcctgtacctcagaacctggccaggcctcccagacctcctnatctatgatgcactcccgacgacgggccacgtcggtcgtccccagtcccgtaggttcaggtggcctaggtggggtctggggactaggtacgttcactctaccacctatccgaagcctaacgcccttagcccgtagttcctaggtaacgtttattttcggactttaaggttttactttagttaggtactaacggtcttaaggttatacggtatacgtaggttccggtacccttacggacttacccgtaccggttcccgggaccgtacgggggacctaccggtaacgtacggaaaaccgtaaaacgttaaaaccggagtaagggttccggacttacggacctaaccttgtaccgtttcg

SEQ ID NO: 360125 - DNA, 672 bp, Homo sapiens
  misc_feature: GZ8MTXP02JAVK5.38.1.A01.1.454.CMB.2.raw
  modified_base (194)..(194): a, c, t, g, unknown or other
  misc_feature (194)..(194): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagcccaccctctcctgcagggccagtcagagtgttagaacactagcctggtaccatcagaacctggccaggctcccagacctcctcatctatgatgcatcccaccgagggcccacgttggtcgtccccagccctagggttccaggtcggctagggtggggtcgtaggggactgggtacgtttcaccgtctaccgacagtcgaacgcctaacggtccctaggacccgtagttaccgtaggtaaaaggttactttttagggacctttaaggtttttaaagtttagtttacggtacttagtaccgttaaaggttattacggtatttaccggaggttccgggccctttaccggacttacccgtaacccggttccggacccgggaaacgggggtaacctaaccgggtacgtaaccgggaaacctaaaaacggttaaacccggaagttacgggtacgggaccttacggacccaaccgttacg

SEQ ID NO: 360126 - DNA, 555 bp, Homo sapiens
  misc_feature: GZ8MTXP02I8O4M.38.1.A01.1.454.CMB.2.raw
  modified_base (191)..(191): a, c, t, g, unknown or other
  misc_feature (191)..(191): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacacctagcctggtaccatcagaacctggccaggctcccagactcctcatctatgatgcactccaccgacgggccacttcgggtcgtcccagccgtaggttcagtcggcaggtgggtctgggacagtgttcactctcaccatcgagcagccctgacagtcgtagtaaagttattttggacttagttttattagtttgtactagtctagttatagagtcaggtcggtacctcgactcgtacccttcggaccgtaggggaccacggacgtacggaaacctaagtaaaacggaacgttaggtcggtactaggacctaacgtacttcg

SEQ ID NO: 360127 - DNA, 540 bp, Homo sapiens
  misc_feature: GZ8MTXP02G9IVT.38.1.A01.1.454.CMB.2.raw
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagaacacctagcctggtaccatcagaacctggccaggcctccagactccctcatctatgatgcatcccaccgacgggccacgtgggtctcccagcctaggttcaggtcggacgtaggtgggtctggggaccaggtcgttcactctacaccatcagcagcctgcagtctagtatgtttcgattagtttattagttgtcagtctagttatgatcgagtcgcctacgatcctaccgttcggaccgtaggggaccacggactacggaaactaagtaaaccgaagtacggtacggtactacggacctaactacttcg

SEQ ID NO: 360128 - DNA, 584 bp, Homo sapiens
  misc_feature: GZ8MTXP02HF1YV.38.1.A01.1.454.CMB.2.raw
  modified_base (318)..(318): a, c, t, g, unknown or other
  misc_feature (318)..(318): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagaacaacctagcctggtaccatcaagaaacctggaccaggcctcccagacctcctcatctatgatgcatcccacgaggccagtggtcnccagtccaggttcaggtcggcaggtcgggtctggggacaggtcgttcactctaccacctatccagcagcctgctagtcgtagacgttattttgacttagtttattatttgtactaggtcagttatagtactcgtaggttcggccctacgtactacccgtacccgtttccggaccggtaagggggaccctacggtaaccgtacggaaaacctaaaacgtaaaacccggtaagtacggtacggacgtacgacccaaccgttacttccg

SEQ ID NO: 360129 - DNA, 525 bp, Homo sapiens
  misc_feature: GZ8MTXP02F90TN.38.1.A01.1.454.CMB.2.raw
  modified_base (226)..(226): a, c, t, g, unknown or other
  misc_feature (226)..(226): n is a, c, g, or t
  modified_base (426)..(426): a, c, t, g, unknown or other
  misc_feature (426)..(426): n is a, c, g, or t
  modified_base (451)..(451): a, c, t, g, unknown or other
  misc_feature (451)..(451): n is a, c, g, or t
tcagtcgatcacgtcacgaccggtgctcgatttagacgtctcatcaggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcagggccagtcagngtgttagaacaacctagcctggtaccatcagaacctggccaggctcccagacctcctcatcatgatgcatcccaccagggcccagtggtctcccagccaggttcacgtggcagtcggggtctggggacaggacttcacttcctccacctatcagcacgcctgcagtctagaagtactttgactagtttattattgtcagntagtatgtatcagtcggcctacgtntctaccgttcggacgacggggacacgtacgtagaacaaacgtaaacgaactagtcggcgtacgacctacctaag

SEQ ID NO: 360130 - DNA, 585 bp, Homo sapiens
  misc_feature: GZ8MTXP02JKQH5.38.1.A01.1.454.CMB.2.raw
  modified_base (192)..(192): a, c, t, g, unknown or other
  misc_feature (192)..(192): n is a, c, g, or t
  modified_base (358)..(358): a, c, t, g, unknown or other
  misc_feature (358)..(358): n is a, c, g, or t
  modified_base (397)..(397): a, c, t, g, unknown or other
  misc_feature (397)..(397): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagaacaacctagcctggtaccatcagaacctggccaggctcccagacctcctcatctatgatgcatccaccgagggccacgtgggtctcccagcctaggttcaggtcggctaggtggtctggggacaggngttccatcacaccatcagcagcctgcagtctagaagttntttgattagtttattagttgtactagtcgtagttagtagtacgtacgtaggtccggtccttaccgtacgttacccgtacccggttaccgggaccggtaacggggaacctaccggtacgtaaccggtaaacctaaacgtaaaaccgtaacgtacggtaccggtacgtacgaccgtaacctacgtttccg

SEQ ID NO: 360131 - DNA, 538 bp, Homo sapiens
  misc_feature: GZ8MTXP02GHCNU.38.1.A01.1.454.CMB.2.raw
  modified_base (192)..(192): a, c, t, g, unknown or other
  misc_feature (192)..(192): n is a, c, g, or t
  modified_base (283)..(283): a, c, t, g, unknown or other
  misc_feature (283)..(283): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
  modified_base (526)..(526): a, c, t, g, unknown or other
  misc_feature (526)..(526): n is a, c, g, or t
  modified_base (535)..(535): a, c, t, g, unknown or other
  misc_feature (535)..(535): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagtaacaacctagcctggtaccatcagaacctggccaggctcccagacctcctnatctatgatgacactcccaccgacggggcccagtgggtcgtaccccagccgtaggttcaggtcggctagggtcgggtctggggacaggtgttcactctcaccatcancagcctgcngtcagtagtactttgacttagtttattatttgtcaggtctagttatgtattcgagtcggtacctcgtatccaccgttcggccgtaggggaccacgagtcgaaacaataaacgaacgttggacggtcngaccacctntcg

SEQ ID NO: 360132 - DNA, 709 bp, Homo sapiens
  misc_feature: GZ8MTXP02JB93T.38.1.A01.1.454.CMB.2.raw
  modified_base (194)..(194): a, c, t, g, unknown or other
  misc_feature (194)..(194): n is a, c, g, or t
  modified_base (256)..(256): a, c, t, g, unknown or other
  misc_feature (256)..(256): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccacctgtctgtgtctccgagggganagacgcccaccctctcctgcagggccagtcagagtgttaagaacactgcctggtaccatcanaacctggccaggcctcccagacctcctcatctatgatcgcatccccacgacgggccctacgtcggtctaccccaggtcccgtaaggtttccagggtcgggaccgtaggggttcggggtacgtaggggaacaggggttacgttccaaccttccaccgtaaaccctatcccgaaacggcccaacggtcccttagacccgttaagttccgtaggttaaaacgtttgtttttacggacttttaaaggtttttttaaactttaagtttcggtaacctaggttaccttaagggtttaacgtaggtaacttcggtaacgggttccggtacccttaccgggtaacttccccggtaacccggttcccggggaccggtaaacgggggaccttaaaccggaccgttaaacggaaactaaaacggtaaaccgtaacgttcggacggcctacggacctacgttacg

SEQ ID NO: 360133 - DNA, 646 bp, Homo sapiens
  misc_feature: GZ8MTXP02FXFR2.38.1.A01.1.454.CMB.2.raw
  modified_base (477)..(477): a, c, t, g, unknown or other
  misc_feature (477)..(477): n is a, c, g, or t
  modified_base (495)..(495): a, c, t, g, unknown or other
  misc_feature (495)..(495): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggaagaaatcgtgatgacgcagtctccagccaccctgtctgtgtctccgaggggagagacgcccaccctctcctgcgagggccagtcagtagtgttaagtaacaacctagcctaggtaccatacaagaaacccgtggacccaggcctaccccagaccctcctacacttctaatggaacggcctaactccccgaaccggaccggggcccctaacggtgggtacccgtcccccgaggtccccgtagggttccaaggggttcggacctaggggttcggtcgtaggggacaggtacgttcactctcaacctatacgagtcacgctgactagtcagtaaagttntttacgattattattgtntacagtacgtagtatagtagtcgtacggtccgtacctacgtacttacccgtaccggtccggaacggaacgggtaaccacggtaacgaacggtaaaacctaaaacgtaacggtacgtcgggtacgtacgtacgacctaacgtcttacgttcg

SEQ ID NO: 360134 - DNA, 598 bp, Homo sapiens
  misc_feature: GZ8MTXP02GGS49.38.1.A01.1.454.CMB.2.raw
  modified_base (193)..(193): a, c, t, g, unknown or other
  misc_feature (193)..(193): n is a, c, g, or t
  modified_base (369)..(369): a, c, t, g, unknown or other
  misc_feature (369)..(369): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttaagtaacaacctagcctggaccatcagaacctggccaggcctccagactcctcatctatgatgcactcccacgacggggccctagtgggtcgtcgacacgcctagggttcaggtggcagggtcggggtcgtaggggacnggggtacgtttccaccttcctaccaacccgtatcccgacgccaacggccctggaccgtagtacctaggtaaagttagttttagtacgttaagtttttactttagtttggtactaggtactaggtatagtatcgaggttcggcctacgtactaccgtaccgttcggaccgtaggggacacggacgtacggaactaaagtaaacgtacgtacggtcggactacgaccacta

SEQ ID NO: 360135 - DNA, 510 bp, Homo sapiens
  misc_feature: GZ8MTXP02JU4D9.38.1.A01.1.454.CMB.2.raw
  modified_base (277)..(277): a, c, t, g, unknown or other
  misc_feature (277)..(277): n is a, c, g, or t
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagaacaactgcctgtaccatcagaacctggcaggctccagactcctnatctatgatgcatccaccagggcccagtggtcgtcccagccaggttcaggtgcgaggtgggtctggggacngagttcacttcncacatcagcagcctgcagtcagagtatttgacttagtttattattgtcagtctagttatgatcgagtcggcctacgatcctaccgttccggcgacggggacacgacgtaggaacctaaagtaaccgaagtcgacggctagacctaacctg

SEQ ID NO: 360136 - DNA, 526 bp, Homo sapiens
  misc_feature: GZ8MTXP02HPDKU.38.1.A01.1.454.CMB.2.raw
  modified_base (193)..(193): a, c, t, g, unknown or other
  misc_feature (193)..(193): n is a, c, g, or t
  modified_base (306)..(306): a, c, t, g, unknown or other
  misc_feature (306)..(306): n is a, c, g, or t
  modified_base (423)..(423): a, c, t, g, unknown or other
  misc_feature (423)..(423): n is a, c, g, or t
tcagtcgatcacgtcacgaccggtgctcgatttagacgtctcatcaggggggaattgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagtaacaacctagcctggtaccatcaagaaacctggccaggcctcccagactcctcatctatgatgcatcccacgngggccagtggtctcccagcctaggttcaggtcggcaggtgggtctggggacagtcgttcactctaccacctatcagcagcctgcagtctagagtatttgacttagtttattattgtnagtacagttatagatcgagtcgcctcgatccgtaccgttcggcgtagggacacgtactaggaacctaaagtaaccgaagtcgacggctacgaccacgtatccg

SEQ ID NO: 360137 - DNA, 544 bp, Homo sapiens
  misc_feature: GZ8MTXP02JM3DN.38.1.A01.1.454.CMB.2.raw
  modified_base (195)..(195): a, c, t, g, unknown or other
  misc_feature (195)..(195): n is a, c, g, or t
  modified_base (268)..(268): a, c, t, g, unknown or other
  misc_feature (268)..(268): n is a, c, g, or t
  modified_base (309)..(309): a, c, t, g, unknown or other
  misc_feature (309)..(309): n is a, c, g, or t
  modified_base (397)..(397): a, c, t, g, unknown or other
  misc_feature (397)..(397): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagaacaactagcctggtaccatcagaacctggcagcnccagactctcatctatgatgcatccacagggccagtggtcncccagccaggttcaggtgacgaggtcggggtctggggacaggtcgttcacttcacaaccatcagcagccctgcagtctagaaagtttntttgacttagtttattattagtactagtctagttagtgtatacgtagtcggaccttaccgactcctaccggtcggaccggaacgggaccaacggtacgacggaaaccaaaagtaaacgaacgtacggtcggactacgacctactacg

SEQ ID NO: 360138 - DNA, 524 bp, Homo sapiens
  misc_feature: GZ8MTXP02INEE8.38.1.A01.1.454.CMB.2.raw
  modified_base (278)..(278): a, c, t, g, unknown or other
  misc_feature (278)..(278): n is a, c, g, or t
  modified_base (373)..(373): a, c, t, g, unknown or other
  misc_feature (373)..(373): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagtaacacctagcctggtaccatcagaacctggccaggctccagactccncatctatgatgcatcccaccgagggccacgtggtctccccagcctaggttcaggtcggcaggtgggtctgggacagtgttcactctcaccatcancagcctgcagtctagaagttattttgcttagtttatttagttgtacagtactagttatgtatcgagtcgcctcgactctaccgttcggcgacggggacacgacgtaggaaactaacgtaaacgaacgtcgtacggctcgaccacctattcg

SEQ ID NO: 360139 - DNA, 533 bp, Homo sapiens
  misc_feature: GZ8MTXP02GAM2H.38.1.A01.1.454.CMB.2.raw
  modified_base (193)..(193): a, c, t, g, unknown or other
  misc_feature (193)..(193): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
  modified_base (386)..(386): a, c, t, g, unknown or other
  misc_feature (386)..(386): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagtaacacctgcctggtaccatcagaactggccaggctccagctcctcatctatgatgcatcccacgaggccagtggtctcccagccaggttcagtcggcaggtgggtctgggacaggtcgttcactcncacntcagcagcctgcagtctagaagtntttgacttagtttattagttgtacagtctagtagtagatcgtagtcgcctacgtactaccgtaccgttcggaccggtacgggaccacgtacgtacgaaactaaacgtaaaacgaacgtcggacggtactacgacctacgtacgttcg

SEQ ID NO: 360140 - DNA, 604 bp, Homo sapiens
  misc_feature: GZ8MTXP02IP66P.38.1.A01.1.454.CMB.2.raw
  modified_base (320)..(320): a, c, t, g, unknown or other
  misc_feature (320)..(320): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagaggagccaccctctcctgcagggccagtcagagtgttagaacaacctagcctggtaccatcaagaaacctggccaggcctcccagacctcctcatctatgatgcactccaccaggccacgtgggtcncccagcctaggttcaggtcgcaggtcgggtctgggacagtgttccactctacaccatcagcagcctagctagtctagtaacgttattttgacttagtttattagttgtacagtctagttatagtagttcgacggttcggtaccctaccggtatcccgtacccgtttaccggggaccggtaaacgggggaacctaacgggtaaccgtacggggtaaaacctaaaacgttaaaaccggtaacgttacgggtacggtacgtacggacctaaacccgttatttcccgg

SEQ ID NO: 360141 - DNA, 597 bp, Homo sapiens
  misc_feature: GZ8MTXP02IHTL7.38.1.A01.1.454.CMB.2.raw
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcagggccagtcagagtgttagtaacacctagcctgaccatcagaactggccaggctccagactcctcatctatgatgaccactccacgagggcccacgtcggtctccccgagcctaggttcaggtggcgaggttggggtctggggactagggtactttcaccttccaccacccaatccagcacgcctgctagtactaggtaagttagttttgacgttaagttttatttacgtttgtacgtaggtactaggttatgtaacttacgtacggttcggaccgttccgtaactcccggtaccgttcgggaccgaacggggtacgaacggtaccgtaacggtaacaaacgtaaaacgtacgtacggtacggacgtacgactaaccgtacg

SEQ ID NO: 360142 - DNA, 554 bp, Homo sapiens
  misc_feature: GZ8MTXP02F7Y0P.38.1.A01.1.454.CMB.2.raw
  modified_base (195)..(195): a, c, t, g, unknown or other
  misc_feature (195)..(195): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (391)..(391): a, c, t, g, unknown or other
  misc_feature (391)..(391): n is a, c, g, or t
  modified_base (419)..(419): a, c, t, g, unknown or other
  misc_feature (419)..(419): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcagggccagtcagagtgttagaacaacctagcctggtaccatcagaaacctggccaggcctcccagacctccnatctangatgacactcccaacgcggcctacgtggtccgtcccagccgtaggttcaggtcgcgtaggtcggggtcgtaggggaactgggtactctactcctacacntcagcacgcctgctagtcagtaaagttntttagacttagtttaattgtgtacagtctaagtatagatacgacggtcgcctacgtactccgtacgtccggacgacggggaccacggtactaacggaactaaaacgaacgtacgttggacgctacgacctactta

SEQ ID NO: 360143 - DNA, 517 bp, Homo sapiens
  misc_feature: GZ8MTXP02GJKIX.38.1.A01.1.454.CMB.2.raw
  modified_base (281)..(281): a, c, t, g, unknown or other
  misc_feature (281)..(281): n is a, c, g, or t
  modified_base (341)..(341): a, c, t, g, unknown or other
  misc_feature (341)..(341): n is a, c, g, or t
  modified_base (409)..(409): a, c, t, g, unknown or other
  misc_feature (409)..(409): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttaagtaacaacctagcctggtaccatcagaacctggccaggctcccagactcctnatctatgatgcatccacaggccatggctcccagccaggtcagtcggcagtggctgggacngtgtcatctacaccatcagcagcctgcagtctagagtattttgacttagtttattagttgtacaagtntagtatgactgagtcgcctacgtatccgaccgtcgggaccgagggaccaacggacgtacgaaaactaaacgtaaaacgaacgttggacggtctacgacctactactcg

SEQ ID NO: 360144 - DNA, 557 bp, Homo sapiens
  misc_feature: GZ8MTXP02G6TD8.38.1.A01.1.454.CMB.2.raw
  modified_base (193)..(193): a, c, t, g, unknown or other
  misc_feature (193)..(193): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttaagtaacaacctagcctggtaccatcaagaacctggccaggcctcccagacctcctcatctatgatgcatcccaccgagggccacgtgggtctcccagcctaggttcaggtcggctaggtgggtctggggacaggcgttcactcctcacctatcagcacgccctgcagtctagacgtatttgacttagtttattagttgtacagtctagttatagactcgagtcggtaccttccgaatccgtacccgttcgggccgtaaggggaccacggacgtacggaaacctaaagtaaaaccgaacgtggtacggactacgacctacctacttcg

SEQ ID NO: 360145 - DNA, 582 bp, Homo sapiens
  misc_feature: GZ8MTXP02IA8JP.38.1.A01.1.454.CMB.2.raw
  modified_base (287)..(287): a, c, t, g, unknown or other
  misc_feature (287)..(287): n is a, c, g, or t
  modified_base (309)..(309): a, c, t, g, unknown or other
  misc_feature (309)..(309): n is a, c, g, or t
  modified_base (425)..(425): a, c, t, g, unknown or other
  misc_feature (425)..(425): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcagggccagtcagagttgttaagaacaactagcctggtaaccatcaagaacctggccaggcctcccagacctcctnatctatgatgcactcccaacgngggccagtgggtcgtcccagccctaggttcaggtcggacagggttcggggtctaggggaccagggtgttccacgttcctaccacctatcagccagcctgactagtctagtaagttnttttgacttagtttaattagttgtacagtactagtatgtactcgaggttcgccttaccgataccgtaccgttccggacggtacggggacctacggaacgtacggaaactaaaacgtaaacggtaacgtgtacggtactacggacctacgtacttccg

SEQ ID NO: 360146 - DNA, 561 bp, Homo sapiens
  misc_feature: GZ8MTXP02JZPRY.38.1.A01.1.454.CMB.2.raw
  modified_base (355)..(355): a, c, t, g, unknown or other
  misc_feature (355)..(355): n is a, c, g, or t
  modified_base (399)..(399): a, c, t, g, unknown or other
  misc_feature (399)..(399): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcagggccagtcagagtgttagaacactagcctggtaccatcagaacctggccaggctcccagacctcctcatctatgatgcatcccaccgagggcccacgtgggtctcccagccaggttcaggtcggcaggtcggctggggacnggcgttcactctacacatcagcacgcctgctagtctagaacgtntttgcttagtttattagtttgtctagtcgtagttagtgtaatcgtaggtcgtcctccgtatccgtaccgttccggacccggtagggggaccacggtacgtacggaaaccaaaacgttaaaaccgtaacgtacggtcggacctacggacctaacctatttccg

SEQ ID NO: 360147 - DNA, 532 bp, Homo sapiens
  misc_feature: GZ8MTXP02HXLSQ.38.1.A01.1.454.CMB.2.raw
  modified_base (195)..(195): a, c, t, g, unknown or other
  misc_feature (195)..(195): n is a, c, g, or t
  modified_base (355)..(355): a, c, t, g, unknown or other
  misc_feature (355)..(355): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagtaacactagcctggtaccatcaagaacctggcccaggcctcccagacctcctcatctatgatgcatccacgaggccagtggtctcccagcctaggtcaggtggctaggtgggtctggggacnggtagttcactctaccacatcagcagcctgcagtctagaagtatttgacttagtttattattgtactagtctagtatgtatcgagtcggacctcgactcctaccgttcggaccgtacggggaccacgacgtacggaaactaaagtaaaacgactaggtacggactcgactacctacg

SEQ ID NO: 360148 - DNA, 514 bp, Homo sapiens
  misc_feature: GZ8MTXP02JYVWE.38.1.A01.1.454.CMB.2.raw
  modified_base (191)..(191): a, c, t, g, unknown or other
  misc_feature (191)..(191): n is a, c, g, or t
  modified_base (279)..(279): a, c, t, g, unknown or other
  misc_feature (279)..(279): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacacctagcctggtaccatcagaacctggccaggctcccagactcctnatctatgatgcatccaccagggccacgtggtctcccagcctaggttcaggtcggcagtggggtctggggaccagtgttcactctcaccatcagcagcctgcagtctgaagtattttgacttagtttatttattgtcagtcagtatagatcgagtggcctccgatccaccgttcggccgaggggaccacggactacggaacaaagtaaaccgaagtgtacggctacgcaccattcg

SEQ ID NO: 360149 - DNA, 505 bp, Homo sapiens
  misc_feature: GZ8MTXP02GC366.38.1.A01.1.454.CMB.2.raw
  modified_base (192)..(192): a, c, t, g, unknown or other
  misc_feature (192)..(192): n is a, c, g, or t
  modified_base (347)..(347): a, c, t, g, unknown or other
  misc_feature (347)..(347): n is a, c, g, or t
  modified_base (349)..(349): a, c, t, g, unknown or other
  misc_feature (349)..(349): n is a, c, g, or t
tcagtcgatcacgtcacgaccggtgctcgatttagacgtctcatcaggggaggaactgctcagttaggacccagacggaaccatggaagccccagcgcagcttctcttcctcctgatactctggctcccagaaatcactggagaaatcgtgatgacgcagtctccagccaccctgtctgtgtctccaggggngagagccaccctctcctgcagggccagtcagagtgttagtaacacctagcctggtaccatcagaacctggccaggctcccagactcctcatctatgatgcatccacagggccacgtggtcgtcccagccaggttcagtgcaggtggtctgggacngngttcactctcacatcagcagctgcagtctgaagtatttgactagtttattattgtctagtcagtatgatcaggttcgcctcgatcgaccgttcggccgaaggggacacggtactacggaacaaacgtaaacgacgtacgtggactcgacacctacg

SEQ ID NO: 360150 - DNA, 599 bp, Homo sapiens
  misc_feature: GZ8MTXP02II71G.38.1.A01.1.454.CMB.2.raw
  modified_base (193)..(193): a, c, t, g, unknown or other
  misc_feature (193)..(193): n is a, c, g, or t
  modified_base (280)..(280): a, c, t, g, unknown or other
  misc_feature (280)..(280): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagaacacctagcctggtaccatcagaaacctggccaggctcccagacctcncatctatgatgcactcccaccgagggccacgtgggtctcccagccctaggttcaggtcggctaggtgggtctggggacaggtgttcactctaccacctagtcagcagcctgctagtctagaagtatttgacttagtttattattgtacagtactaggttatagtagtacgaggttcggacccttaccgtacgtacccgtacccggtttacgggacccggaacgggggaacctaaaccgggtaccgttaacggggaaaacctaaaacgtaaaaccggaacgttggtacggacctacggaccctaaccgttacgtttaccg

SEQ ID NO: 360151 - DNA, 595 bp, Homo sapiens
  misc_feature: GZ8MTXP02HI6RH.38.1.A01.1.454.CMB.2.raw
  modified_base (196)..(196): a, c, t, g, unknown or other
  misc_feature (196)..(196): n is a, c, g, or t
  modified_base (278)..(278): a, c, t, g, unknown or other
  misc_feature (278)..(278): n is a, c, g, or t
  modified_base (356)..(356): a, c, t, g, unknown or other
  misc_feature (356)..(356): n is a, c, g, or t
  modified_base (403)..(403): a, c, t, g, unknown or other
  misc_feature (403)..(403): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtcctccgagggganagagcccaccctctcctgcagggccagtcagagtgtagaacactagcctggaccatcagaacctggccagctccagactccnatctatgatcgcatcccaacgacgggccacgtggtcacccgagcctaggttcacggtggctaggtgggtctggggacngagtttccacgtctacacatcagcagccctgctagtctagaagtttntttacgacttagtttattagttcgtacgtagtactagttatgtacttacgtacggttccgtacccgtaccgtacgttacccgttacccgttacccgggaccgggaacggggtaccgtaacggtaaccgtaacggtaaaacgtaaaacggtaaaaccggtaacgttacggtacgtacgtaccgacctactacg

SEQ ID NO: 360152 - DNA, 552 bp, Homo sapiens
  misc_feature: GZ8MTXP02IMGWX.38.1.A01.1.454.CMB.2.raw
  modified_base (192)..(192): a, c, t, g, unknown or other
  misc_feature (192)..(192): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagtaacaactagcctgaccatcagaaactggccaggctccanacctccnatctangatgcatcccaccgagggccagtgggtctcccagcctaggtcagtcggcaggtggtctggggacnggtagttcactctacacctntcgagcctagccctagccagtctagtaagttatttgacttagtttacttattcgtacagtcgtaagttatagtctcgtaggtcggtcctacgacgtcctacccggttcggacccggtaggggaccacggtacgtacggaaactaacgtaaacgaacgtggtacgactacgcctacctagtccg

SEQ ID NO: 360153 - DNA, 523 bp, Homo sapiens
  misc_feature: GZ8MTXP02GM0O0.38.1.A01.1.454.CMB.2.raw
  modified_base (193)..(193): a, c, t, g, unknown or other
  misc_feature (193)..(193): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagagccaccctctcctgcagggccagtcagagtgttagtaacactagcctggtaccatcagaacctggccaggctccagactcctcatctatgatgcatccacaggccatggctcccagcctaggtcaggtcggcaggtgggctggggacagtcgttcacgtctcaccatccagcagcctgcagtctgaagtattttgacttagtttattattgtcagtctagtatgtaactcgagtcggcctccgatccgacgttcggaccgaggggaccacggactacggaacaaacgtaaacggaacgtggtacggcctaggacctaccgtattccg

SEQ ID NO: 360154 - DNA, 565 bp, Homo sapiens
  misc_feature: GZ8MTXP02GU0JM.38.1.A01.1.454.CMB.2.raw
  modified_base (195)..(195): a, c, t, g, unknown or other
  misc_feature (195)..(195): n is a, c, g, or t
  modified_base (282)..(282): a, c, t, g, unknown or other
  misc_feature (282)..(282): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccacctctcctgcagggccagtcagagtgttagtaacacctagcctggtaccatcagaacctggccaggcctcccagcctccnatctatgatgcactcccacgagggccacgtggtctcccagccaggttcaggtgcaggtggcngggacngnttcactcncacntcagcacgctgactgtctagaagttattttgacttaagttttattagttgtactagtctaaggttactaggtacttcgtaggttcggaccccttacggtacttccgtaacccggttcggggacccggtaaacgggggacctaacgggacgtaacgggaaactaaaacggtaaacgtacgtggtacggactcgaccaccgta

SEQ ID NO: 360155 - DNA, 512 bp, Homo sapiens
  misc_feature: GZ8MTXP02GERXX.38.1.A01.1.454.CMB.2.raw
  modified_base (192)..(192): a, c, t, g, unknown or other
  misc_feature (192)..(192): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagtaacacctagcctggtaccatcagaacctggccaggctcccagacctcctcatctatgatgcatcccacgagggccacgtggtctcccagccaggttcaggtcggcaggtgggtctgggacagtcgttcactctcaccatccagcagccctgcagtctagagtatttgacttagtttattattgtacagtctagtatgatcgagtcgcctcgatcaccgtcggcgagggacacgacgtaggaacaagtaaacgaacgtgtacggactgacctaccgattcg

SEQ ID NO: 360156 - DNA, 534 bp, Homo sapiens
  misc_feature: GZ8MTXP02HOGXM.38.1.A01.1.454.CMB.2.raw
  modified_base (195)..(195): a, c, t, g, unknown or other
  misc_feature (195)..(195): n is a, c, g, or t
  modified_base (364)..(364): a, c, t, g, unknown or other
  misc_feature (364)..(364): n is a, c, g, or t
  modified_base (408)..(408): a, c, t, g, unknown or other
  misc_feature (408)..(408): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccacctctcctgcagggccagtcagagtgttagtaacaactgcctggtaccatcaagaacctggaccaggcctccagacctcctcatcgtatgatgcactacccacgacgggcctacgtggtctcccagccctaggttcagttggcaggtgggtctaggggacnggtacttcactctacaaccatcagcagcctgcagtctagaagtntttcgatagtttattattgtatagataggttatgactcgtaggtcggcccttaccgaactcctacccgttcggaccgaggggaccacgactacggaacaaagtaaacgagtgtcgactcgactaca

SEQ ID NO: 360157 - DNA, 516 bp, Homo sapiens
  misc_feature: GZ8MTXP02GJTUM.38.1.A01.1.454.CMB.2.raw
  modified_base (286)..(286): a, c, t, g, unknown or other
  misc_feature (286)..(286): n is a, c, g, or t
  modified_base (442)..(442): a, c, t, g, unknown or other
  misc_feature (442)..(442): n is a, c, g, or t
  modified_base (480)..(480): a, c, t, g, unknown or other
  misc_feature (480)..(480): n is a, c, g, or t
  modified_base (504)..(504): a, c, t, g, unknown or other
  misc_feature (504)..(504): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctcctgcagggccagtcagagtgttaagtaacactagcctggtaccatcaagaacctggaccaggcctcccagacctcctnatctatgatgcatccaccgaggccagtggtctcccagcctaggttcaggtcggctaggtggtcgtaggggacaggtcgttccactcgtacaccatcagcagcctgactagtactagaattagttttcgattagtttattattgtacagtcagttangaactgagtcgctcgatcacgtcgcgagggtcagtacncgaaacaagtaacgaagtgtacgntacgacactatc

SEQ ID NO: 360158 - DNA, 513 bp, Homo sapiens
  misc_feature: GZ8MTXP02HC81E.38.1.A01.1.454.CMB.2.raw
  modified_base (282)..(282): a, c, t, g, unknown or other
  misc_feature (282)..(282): n is a, c, g, or t
  modified_base (315)..(315): a, c, t, g, unknown or other
  misc_feature (315)..(315): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctccagaaatcactggagaaatcgtgatgacgcagtctccagccaccctgtctgtgtctccgaggggagagagcccaccctctcctgcagggccagtcagagtgttagtaacactagcctggtaccatcagaacctggccaggcctccagactcctnatctatgatgcactccacgaggccacgtggtcncccagcctaggttcagtgcaggtgggctgggacaggtnttcactcncacatcagcagcctgcngtctagaattntttgacttagtttattagttgtctagctaagtatgatcagtcggcctcgatccgtaccgttcggacgacgggacacgacgtacggaactaaagtaacgacgtcggtacggctgacctaccgtag

SEQ ID NO: 360159 - DNA, 529 bp, Homo sapiens
  misc_feature: GZ8MTXP02HL9FG.38.1.A01.1.454.CMB.2.raw
  modified_base (193)..(193): a, c, t, g, unknown or other
  misc_feature (193)..(193): n is a, c, g, or t
  modified_base (358)..(358): a, c, t, g, unknown or other
  misc_feature (358)..(358): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttagaacactgcctggtaccatcagaacctggccaggcctcccagactcctcatctatgatgcatcccaccgaggccacgtgggtcgtcccagcctaggttcaggtcggcaggtgggtctggggacaggngttccactctcaccatcagcagcctgcagtctgtaagtatttgacttagtttattattgtcagtcgtattagtgtatcgagtcgcctcgtatccaccgttcggaccgtaggggaccacggtacgtacggactaaacgtaaacgaacgtaggtacggactagccactactcg

SEQ ID NO: 360160 - DNA, 502 bp, Homo sapiens
  misc_feature: GZ8MTXP02JUR7B.38.1.A01.1.454.CMB.2.raw
  modified_base (356)..(356): a, c, t, g, unknown or other
  misc_feature (356)..(356): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagtaacaactagcctggtaccatcagaaacctggccaggctcccagactcctcatctatgatgcatcccaccaggggccacgtggtcgtcccagccaggttcaggtcggcagtgggtctggggacagngttcactctcaccatcagcagcctgcagtctagaagtattttgcttagtttattattgtcagctagtatgatcgagtcgcctcgatcgaccgttcggccgaggggacacgactcggaacaagtaaacgaagtgtcgctgcacatcg

SEQ ID NO: 360161 - DNA, 523 bp, Homo sapiens
  misc_feature: GZ8MTXP02GFK4K.38.1.A01.1.454.CMB.2.raw
  modified_base (193)..(193): a, c, t, g, unknown or other
  misc_feature (193)..(193): n is a, c, g, or t
  modified_base (511)..(511): a, c, t, g, unknown or other
  misc_feature (511)..(511): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcagggccagtcagagtgttagtaacacctagcctggtaccatcaagaacctggccaggcctcccagacctcctacatctatgatgcatcccaccgagggcccagtggtctccccagcctaggttcaggtcggcaggtgggtctgggacaggtgttcactctacaccatcagcagcctgcagtctagagtatttgctagtttattattgcagcagtatgatcgagtcgacctcgatcctaccgttcggaccgaggggaccacggacgtaggaaccaaagtaaaaccgaacgtggcggaccncgacactactcg

SEQ ID NO: 360162 - DNA, 535 bp, Homo sapiens
  misc_feature: GZ8MTXP02ILC7Q.38.1.A01.1.454.CMB.2.raw
  modified_base (280)..(280): a, c, t, g, unknown or other
  misc_feature (280)..(280): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccacctgtctgtgtctccgaggggagagacgccaccctctcctgcagggccagtcagagtgttagtaacactgcctggtaccatcagaacctggcagcctccagacctcctnatctatgatcgcactcccacgacgggcccacgtggtcgtccccagcctaggttcagtggcaggtgggctgggacnggtnttcacttcncacntcancagctgcngtctgtaagttagtttgacttagtttaatttagtttgtacgtagtctagtatgtatcgtaggtcgtccttccgactccgtaccgttcggaccggacggggacacggacgtacggtaacaaagtaaaacgacgtagtcgacgtacgcactac

SEQ ID NO: 360163 - DNA, 691 bp, Homo sapiens
  misc_feature: GZ8MTXP02F6H6L.38.1.A01.1.454.CMB.2.raw
  modified_base (195)..(195): a, c, t, g, unknown or other
  misc_feature (195)..(195): n is a, c, g, or t
  modified_base (575)..(575): a, c, t, g, unknown or other
  misc_feature (575)..(575): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcagggccagtcagagtgttagtaacaactagcctggtaccatacaacgaaacctggaccacggcctacccgagtacctccctacactctatgtatcgacctactaccccgaaccggacggggtacccctacggttcgggtacccgtacccccgacggtccccgtaaggggtttccgaacgggttcggggccgttaaggggtcggggttacgtacgggggaactacgggttaacgttccctaaaccgtttcccacctaaccctagtacccaggccctacgtcccgtaggacctagttcgtaggtaaagttgttttgaacgtttaagtttttaattacgttggtactacgtagttaaagttanagtactacgtacggtcgtaccctacgtacgtaccgtaccggttcgggaccggaacgggaccacggtacgtaacgaactaaaacgaacgtacgtaggtacgtacacgacctactacg

SEQ ID NO: 360164 - DNA, 630 bp, Homo sapiens
  misc_feature: GZ8MTXP02IUOL6.38.1.A01.1.454.CMB.2.raw
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagtaacactagcctggtaccatcagaaacctggccaggctcccagacctcctcatctatgatcgcactccccaccgacggggcccctacgttgggttcgtcccccgagccccgtaaggttccaggtggccagggttcggggtctggggacctagggtacgtttccacctcctaccaaccattcccagcacgccctgacctagttcctaggtaagttattttaggaccttaggttttaatttagtttacggttacgtaggtctaagttagtgtaagtccgtaaggttcgggacccttcccgacttcccgtacccgttccgggaccgacgggggtaaccacggtacgtacggaactaaaacgtaaaaccggtacgtaggtacgcgtacgaccaccgttacg

SEQ ID NO: 360165 - DNA, 560 bp, Homo sapiens
  misc_feature: GZ8MTXP02H275W.38.1.A01.1.454.CMB.2.raw
  modified_base (190)..(190): a, c, t, g, unknown or other
  misc_feature (190)..(190): n is a, c, g, or t
  modified_base (277)..(277): a, c, t, g, unknown or other
  misc_feature (277)..(277): n is a, c, g, or t
  modified_base (356)..(356): a, c, t, g, unknown or other
  misc_feature (356)..(356): n is a, c, g, or t
tcagtcgatcacgtcacgaccggtgctcgatttagacgtctcatcaggggggaactgctcagttaggacccagacggaccatggaagccccagcgcagcttctcttcctcctgatactctggctcccagaaatcactggagaaatcgtgatgacgcagtctccagccacctgtctgtgtctcgagggganagacgcccacctctcctgcagggccagtcagagtgtagaacaactagcctggacatcaagaaacctggccaggcctaccagacctcncatctatgatgcatcccaacgcgggccacgtggtcgtcccagcccgtaggttcaggtcggactaggtgggcgtgggacnggtacttcactctacactatcagcacgcctgcagtctagtaagtatttgactttagtttattagttgtactaggtatagtatagtacgtcgtaggtccggtacctcgtactccgtaccgttcggaccgtaggggaccaacggacgtaacggaaactaaaacgttaacggaacgttcggacggtactacgaccgtacctattccg

SEQ ID NO: 360166 - DNA, 531 bp, Homo sapiens
  misc_feature: GZ8MTXP02I2FFF.38.1.A01.1.454.CMB.2.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
  modified_base (510)..(510): a, c, t, g, unknown or other
  misc_feature (510)..(510): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggcctcccagaaatcactggaagaaatcgtgatgacgcagtctccagccaccctgtctgtgtctccgagggganagacgcccaccctctcctgcagggccagtcagagtgttaagaacaacctgcctggtaccatcagaacctggccaggcctcccagctcctnatctatgatcgcactcccacgagggccctacgtggtctcccagccgtaggttcaggtggctaggtgggtcaggggacaggtcttcaactcacacatcagcacgcctgctagtcgtagaaagttctttgattagttttattgttgtactagtactagtatgtatacgagtcgcctacgtatcccgtacgtcggccgaagggacacgacgtacgaacaaataagngaacgtgtacgctacgactac

SEQ ID NO: 360167 - DNA, 558 bp, Homo sapiens
  misc_feature: GZ8MTXP02J2GXI.38.1.A01.1.454.CMB.2.raw
  modified_base (195)..(195): a, c, t, g, unknown or other
  misc_feature (195)..(195): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagcccaccctgtctgtgtcctccgagggganagacgcccaccctctcctgcagggccagtcagagtgttaagaacactagcctggtaccatcagaacctggccaggcctcccagacctcctcatctatgatgcactcccaccgagggccacgtgggtctcccagcctaggttcaggtcggcaggtgggtctggggacagtcgttcactcacaccatcagcacgcctgctagtctagtaagttattttgactttagtttattagttgtacagtctagttatagtatcgtaggtcgtccctcgtactccgtaccgttcgggaccgaggggaccaacgtacgtacgaaacctaaaacgtaaacgaacgtcggtacgactacgacctaaccgtactcg

SEQ ID NO: 360168 - DNA, 556 bp, Homo sapiens
  misc_feature: GZ8MTXP02G4H25.38.1.A01.1.454.CMB.2.raw
  modified_base (363)..(363): a, c, t, g, unknown or other
  misc_feature (363)..(363): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgccagggccagtcagagtgttagtaacaacctagcctggtaccatcagaacctggccaggcctcccagacctcctcatctatgatcgcatcccacgagggcccagtggtctccccagccaggttcaggtggctaggtggggtctggggacnggtacgttcactctacaccatcagcagcctgcagtctagaagttactttgacttagttttattgttacggtactaggtctaaggttatgtaattcgaggttcggacccttcgacttccctaccggttcgggaccgacggggacacggacgtacggaactaaagtaaacgactggtacggctacgcctaccgta

SEQ ID NO: 360169 - DNA, 549 bp, Homo sapiens
  misc_feature: GZ8MTXP02HP785.38.1.A01.1.454.CMB.2.raw
  modified_base (193)..(193): a, c, t, g, unknown or other
  misc_feature (193)..(193): n is a, c, g, or t
  modified_base (286)..(286): a, c, t, g, unknown or other
  misc_feature (286)..(286): n is a, c, g, or t
  modified_base (320)..(320): a, c, t, g, unknown or other
  misc_feature (320)..(320): n is a, c, g, or t
  modified_base (363)..(363): a, c, t, g, unknown or other
  misc_feature (363)..(363): n is a, c, g, or t
  modified_base (395)..(395): a, c, t, g, unknown or other
  misc_feature (395)..(395): n is a, c, g, or t
  modified_base (411)..(411): a, c, t, g, unknown or other
  misc_feature (411)..(411): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctccagaaatcactggaagaaatcgtgatgacgcagtctccagccacctgtctgtgtctcgagggganagacgcccacctctcctgccgagggccagtcagagtgttaagtaacaactgcctggaccatcaagaacctggccaggcctacccagacctccncatctatgatcgcactccacgaggccagtggtcncccagtccaggttcaggtcggactagggtgggtcaggggaacngtacgttcaaccttcacaccatccagcagccngcagtctagaagtttnttagattaagtttatttgtagtactagtactagtatgtatcgtacggtcgaccttacgactccgtaccgtacggaccggacggacacggtacgtaacgaaactaaaacgtaacgtacgtggtcgacacgtaccacgtc

SEQ ID NO: 360170 - DNA, 641 bp, Homo sapiens
  misc_feature: GZ8MTXP02JZV2N.38.1.A01.1.454.CMB.2.raw
  modified_base (193)..(193): a, c, t, g, unknown or other
  misc_feature (193)..(193): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttaagtaacaactagcctggtaccatcaagaacctggccaggcctccagactccnatctangatgcancccacgaggccagtggtcctacccagcctaggttcaggtcggactagggttcgggtacgtggggaactagggtacgtttcaactctaccaacctagtccgaagccacgtcccgtgacgtagtcgtagtaaggttactttttggacctttagttttaatttacgttacggtaccgtaaggtacttaaggtttaagtgtaaactttcggaaggttccggtacccttaccggtacttaccgtaaccccggtttcggacccgggtaggggaaccctacgggaacttacgggaaaacttaaacggtaaaacgaacggttacggcggtacctaggaccctaaccgttactcg

SEQ ID NO: 360171 - DNA, 543 bp, Homo sapiens
  misc_feature: GZ8MTXP02FWIKZ.38.1.A01.1.454.CMB.2.raw
  modified_base (195)..(195): a, c, t, g, unknown or other
  misc_feature (195)..(195): n is a, c, g, or t
  modified_base (280)..(280): a, c, t, g, unknown or other
  misc_feature (280)..(280): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcgagggccagtcagagtgttagaacacctgcctggtacatcagaacctggccagctccagcctccnatctatgatgcactcccacgagggccctacgtggtctccccagcctaggttcaggtggcagggttcggggtctaggggactgggtacttcactcctacacctagtcacgctacgcctgctagtcagtaagttatttgacttagttttattagttgtacagtctagtatgatcgaggtcgcctcgatcctaccgttcggacgaggggacctacggacgtacggaactaaaagtaacgtacgtggacggactcgacctacgtacg

SEQ ID NO: 360172 - DNA, 659 bp, Homo sapiens
  misc_feature: GZ8MTXP02FU73T.38.1.A01.1.454.CMB.2.raw
  modified_base (193)..(193): a, c, t, g, unknown or other
  misc_feature (193)..(193): n is a, c, g, or t
  modified_base (295)..(295): a, c, t, g, unknown or other
  misc_feature (295)..(295): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagtccaccctctcctgcagggccagtcagagtgttaagtaacacctagcctggtacccatcaagaacctggaccaggcctccgagacctcctacatctangatgcactccaccgaggccacgtcggtctcccgagcctaggttcaggtcggctagggtcgggtcgtgggaacctaggtacgttccacgttcctacccgaacctatcgaacgccacgcccgttagaccctaggttcctaaggtaagtttagtttttacgacgtttaagtttttaagtttagtttcggtacgtaaggtactaaggttagtagtacgttaccgtaggttccggtacccctacggtaaccttcccgtaacccgttcggggacccggtaaaggggacccctaaacggtacgtacgggaaaacctaacggttaaaaccgtaacgttacggtacggacctacggacctacctacgtttccg

SEQ ID NO: 360173 - DNA, 587 bp, Homo sapiens
  misc_feature: GZ8MTXP02JPW3T.38.1.A01.1.454.CMB.2.raw
  modified_base (197)..(197): a, c, t, g, unknown or other
  misc_feature (197)..(197): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggcctcccagaaatcactggaagaaatcgtgatgacgcagtctccagccaccctgtctgtgtctccgagggganagacgcccaccctctcctgcgagggccagtcagagtgttaagaacaactgcctggtaccatcaagaaacctggaccaggcctacccagacctcctcatctatgatgcactccacgaggccacgtggtctcccagccaggttcaggtggactgggtcggggtcgtaggggactaggtacgttcaccgttcctccaacctactcgaacgcacgtccgtggctagttctaggaaacgtttagttttgacgtttagttttatttagtttgtactagtactaagttatggtaactcggtagtcggccttacgtactccgtaccgtcgggaccggtacgggaccacggacgtacggaactaaaacgtaaacgacgttcgacggctacgctaacctg

SEQ ID NO: 360174 - DNA, 525 bp, Homo sapiens
  misc_feature: GZ8MTXP02GV7K5.38.1.A01.1.454.CMB.2.raw
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (396)..(396): a, c, t, g, unknown or other
  misc_feature (396)..(396): n is a, c, g, or t
  modified_base (429)..(429): a, c, t, g, unknown or other
  misc_feature (429)..(429): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagccaccctctcctgcagggccagtcagagtgttagtaacaactagcctggtaccatcagaacctggccagcctcccagacctcctcatctatgatgcatccaccgagggccacgtggtcgtcccagccaggttcaggtgcaggtgggtcngggacnggtgttcactctcaccatcagcagcctgctagtctagaagtntttgactagttttatagttgtactagctaggtntagattcgaggtcgcctcgatcctaccgtcggacgaggggtaccacggactacggaactaaaagtaaacgtactggtacgcgtagaccctactacg

SEQ ID NO: 360175 - DNA, 685 bp, Homo sapiens
  misc_feature: GZ8MTXP02GWFZY.38.1.A01.1.454.CMB.2.raw
  modified_base (194)..(194): a, c, t, g, unknown or other
  misc_feature (194)..(194): n is a, c, g, or t
  modified_base (227)..(227): a, c, t, g, unknown or other
  misc_feature (227)..(227): n is a, c, g, or t
  modified_base (293)..(293): a, c, t, g, unknown or other
  misc_feature (293)..(293): n is a, c, g, or t
  modified_base (432)..(432): a, c, t, g, unknown or other
  misc_feature (432)..(432): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccacctgtctgtgtctccgagggganagacgcccaccctctcctgcagggccagtcagngtgttaagaacactagcctggtaccatcagaaacctggccaggcctcccagacctcctcatctaangatcgacactccaccgaggccacgtggtctcccagcctaggttcacggtgcgtagggtgggtcgtggggaactgggtagtttccaccttcctaccaccatcgacgcacgtccctaggccaggttactaggtaaagtttntttttagggactttaaggtttttaaatttagttttacgtaccgttaaggtacttaagggtttaattacggtaatccggttaaggtaccggttaccccttccggtaaaccgttcccggtaaaccccgtttccgggggaaaccgtaaaccggggggtaccctaaaaccggggttaccgtaacgggaaaaccgtttaaaacgaaacccggttaaggttacgggttacgggcctacggtaccgtaaacccgtttacg

SEQ ID NO: 360176 - DNA, 539 bp, Homo sapiens
  misc_feature: GZ8MTXP02HVZRN.38.1.A01.1.454.CMB.2.raw
  modified_base (193)..(193): a, c, t, g, unknown or other
  misc_feature (193)..(193): n is a, c, g, or t
  modified_base (379)..(379): a, c, t, g, unknown or other
  misc_feature (379)..(379): n is a, c, g, or t
  modified_base (405)..(405): a, c, t, g, unknown or other
  misc_feature (405)..(405): n is a, c, g, or t
  modified_base (440)..(440): a, c, t, g, unknown or other
  misc_feature (440)..(440): n is a, c, g, or t
  modified_base (528)..(528): a, c, t, g, unknown or other
  misc_feature (528)..(528): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagtagtgttagtaacacctagcctgaccatcagaacctgccaggctcccagacctctcatctatgatgcatcccaccgagggcccagtggtcgtccctagtctacggttcaggtcggctagggttcgggtcgtgggacaggtcgttcactctccacntcagcagccctgcagtctagaagttntttgacttagtttattattgtacagttacaagttntagtatcgtagtcggccctacggatccctaccgttcggcgaacgggacacgtacgtacggaacaagtaaacgaacgtgtacggactanactactactcg

SEQ ID NO: 360177 - DNA, 523 bp, Homo sapiens
  misc_feature: GZ8MTXP02H33NO.38.1.A01.1.454.CMB.2.raw
  modified_base (190)..(190): a, c, t, g, unknown or other
  misc_feature (190)..(190): n is a, c, g, or t
  modified_base (274)..(274): a, c, t, g, unknown or other
  misc_feature (274)..(274): n is a, c, g, or t
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
  modified_base (413)..(413): a, c, t, g, unknown or other
  misc_feature (413)..(413): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccacctgtctgtgtctccgaggganagagccacctctcctgcagggccagtcagagtgttagaacaactagcctgtaccatcagaacctggcaggctcccagacctctnatctatgatgcatcccacagggccacgtggtcgtcccagcctaggtcaggtcgcaggtgggtctgggacagtgttcactctcaccntcagcagccngctagtctagtaagtattttgacttagtttatattgtacagtntagtatgatcgagtcgcctaccgactacgtacccgttcggaccgtaggggaccacggactacggaacaaaagtaaacgaacgttgacggtacacggtacaaccgtactcg

SEQ ID NO: 360178 - DNA, 595 bp, Homo sapiens
  misc_feature: GZ8MTXP02JEMWB.38.1.A01.1.454.CMB.2.raw
  modified_base (194)..(194): a, c, t, g, unknown or other
  misc_feature (194)..(194): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (368)..(368): a, c, t, g, unknown or other
  misc_feature (368)..(368): n is a, c, g, or t
  modified_base (440)..(440): a, c, t, g, unknown or other
  misc_feature (440)..(440): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctccagaaatcactggagaaatcgtgatgacgcagtctccagccaccctgtctgtgtctccgagggganagacgcccaccctctcctgcagggccagtcagagtgttaagaacaacctgcctggaccatcaagaacctggccaggcctcccagacctcctnatctangatgcatcccacgagggccacgtggtctccccagtccctagggttcacggtcggactaggttggggtctagggacngggtcttcacgttccaccacctagtcagcagccctagcgaagtctagaagttatttcgacttagttttattnttagtactagtactaggtatgaatcgaggtcgtacctaccgtactccgtaaccggttcgggaccgtaacggggaccctaacggaccgtagggaaacctaaaacggtaaaaccggtacgtacggggtaccggtacaccggtaccgtaacgtaaccg

SEQ ID NO: 360179 - DNA, 566 bp, Homo sapiens
  misc_feature: GZ8MTXP02JQXL6.38.1.A01.1.454.CMB.2.raw
  modified_base (192)..(192): a, c, t, g, unknown or other
  misc_feature (192)..(192): n is a, c, g, or t
  modified_base (204)..(204): a, c, t, g, unknown or other
  misc_feature (204)..(204): n is a, c, g, or t
  modified_base (281)..(281): a, c, t, g, unknown or other
  misc_feature (281)..(281): n is a, c, g, or t
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctntcctgcagggccagtcagagtgttagtaacaacctagcctggtaccatcagaacctggccaggctccagacctcctnatctatgatgcatccacagggccacgtggtcgtcccagcctaggttcagtcggcaggtgggtctgggacagngttcactcncaccatcagcagcctgcagtctagaagtattttcgacttagttttattacgttgtaccaaggtctaagtattgaacttcgaaggttcggccttacggtactccgtaccgttccggccgtaagggggacctaacggaccgtagggaaaacctaaacgttaaaacggaacgttcggtacggacttaggaccctaaccgtatttccg

SEQ ID NO: 360180 - DNA, 655 bp, Homo sapiens
  misc_feature: GZ8MTXP02IISC0.38.1.A01.1.454.CMB.2.raw
  modified_base (195)..(195): a, c, t, g, unknown or other
  misc_feature (195)..(195): n is a, c, g, or t
  modified_base (286)..(286): a, c, t, g, unknown or other
  misc_feature (286)..(286): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgtagtaacactagcctaggaccatcagaaacctggaccaggcctaccagacctcctnatctatgatcgactacgtcccacgagggccctagtgggtcctacccagtcccgtaaggttcacggtcggacagggttcggggtactggggactaggtacgttaccaccttaccacccacgtaatccgagcaacgccctgacgtacgttacgtagtaaagttacgttttcggactttaaggttttactttaacgtttggactaaggtctaagttatagtaacgttcgtaacggttcggtacccttacggtaacttacccggtaccccgttagggggaccccgaaagggggtaaccaaccggtacgtaacgggtaaaactaaacggggtaaaacctcggtacggtaccggatacccggaactaaccgttcg

SEQ ID NO: 360181 - DNA, 599 bp, Homo sapiens
  misc_feature: GZ8MTXP02GO3DY.38.1.A01.1.454.CMB.2.raw
  modified_base (195)..(195): a, c, t, g, unknown or other
  misc_feature (195)..(195): n is a, c, g, or t
  modified_base (428)..(428): a, c, t, g, unknown or other
  misc_feature (428)..(428): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcagggccagtcagagtgttagtaacactagcctggtaccatcagaaacctggccaggcctcccagacctcctcatctatgatcgacatcccgacgacgggccacgtggtcgtaccccagcctaggttcaggtcggctaggtcgggtcgtagggactaggtacgttccactcctaccaactatccgagcacgccctgcagttacgagtaaagtttnttagacgtttagtttattagtgtacgtagtactaagttagtagtagtaccgtaggtccggtacccgtacgtactcccgtacccggttaccgggaccgggaaacgggacaacggtacgtaacggaaactaaaacgtaaaccggtacgtcggtacgcgtacgacctacgtacg

SEQ ID NO: 360182 - DNA, 659 bp, Homo sapiens
  misc_feature: GZ8MTXP02HB6BU.38.1.A01.1.454.CMB.2.raw
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgccagggccagtcagagtgttaagtaacacctgctggtaccatcaagaacctggccaggcctcccagacctcctcatctatgatcgcactcccaccgagggcccacgttcgggcgtcccacggccgtaggttcgagtcgggcctagggttcggttcgtaggggacacgggtacgtttccacgttcctacctaacctagttaccgagaccgacgcccgttagccgttacggtacgttaggtaaagtttagtttttcgaacgtttagtttttaatttagtttacggtactaagtagtaagttagtcgtattaccgtaggtccggtaccctaccgtacgtacccgtaacccggttcgggacccgtaacgggggaacccaaccggtacgtaccggaaaactaaacggtaaaacccgtaagtcggtacggtacgtacgaccgtactactttacg

SEQ ID NO: 360183 - DNA, 516 bp, Homo sapiens
  misc_feature: GZ8MTXP02FGC70.38.1.A01.1.454.CMB.2.raw
  modified_base (194)..(194): a, c, t, g, unknown or other
  misc_feature (194)..(194): n is a, c, g, or t
  modified_base (206)..(206): a, c, t, g, unknown or other
  misc_feature (206)..(206): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (386)..(386): a, c, t, g, unknown or other
  misc_feature (386)..(386): n is a, c, g, or t
  modified_base (421)..(421): a, c, t, g, unknown or other
  misc_feature (421)..(421): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctntcctgcagggccagtcagagtgttagtaacaacctagcctggtaccatcagaaacctggccaggctcccagactcctcatctatgatgcatccacaggggccactggtcgtccccagccaggttcagtggcaggtgggtcnggggacngagttcatctcacatcagcagtcctgcagtcngaaagtattttgctagtttattatgtcagctagtntgatcagtggacctcgatccaccgttcggcgaacggggacacgacgtacggaacaaaacgtaaacggaacgttcggcggtctaggacccaccgta

SEQ ID NO: 360184 - DNA, 578 bp, Homo sapiens
  misc_feature: GZ8MTXP02F9XL6.38.1.A01.1.454.CMB.2.raw
  modified_base (288)..(288): a, c, t, g, unknown or other
  misc_feature (288)..(288): n is a, c, g, or t
  modified_base (321)..(321): a, c, t, g, unknown or other
  misc_feature (321)..(321): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctcctgcagggccagtcagagtgttaagtaacaacctagcctaggtaccatcaagaacctggccaggcctcccagacctccncatctatgatgcatccacgaggccacgtggtcncccagccaggttcaggtcgctaggtcggggtctggggacagtcgttccacttctccaccatcagcagcctgacagtctagagtatttgcttagtttattattgtactagtactagttatagacttacgaggttcggtaccttaccgtaacttccgtacccggttacgggacccgaagggggacctaacggacgtaacggaaacctaaaagttaaaaccgaacgttggtacggtacgtacgacctaccgtactttccg

SEQ ID NO: 360185 - DNA, 611 bp, Homo sapiens
  misc_feature: GZ8MTXP02FQG9D.38.1.A01.1.454.CMB.2.raw
  modified_base (193)..(193): a, c, t, g, unknown or other
  misc_feature (193)..(193): n is a, c, g, or t
  modified_base (390)..(390): a, c, t, g, unknown or other
  misc_feature (390)..(390): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttaagtaacaacctagcctggtacccatcaagaaacctggcccaggcctcccagacctcctcatctatgatgcactccaccgagggccagtgggtctcccagtcccaggttcaggtggctaggtgggtcgtgggaccagtcgttcactccaccaccatccgancagccgtgactagtctagtaagtattttgacttagtttattagtttgtacaggtctaagttagtagtatcgtaaggtcgggtaccctaccgtactacccgtaccgttaccgggacccggtaacgggggacctaaccggtaacgtacgggtaaaacgtaaaacgtaaaaaccggtaacgttacggtacggtaccgttacgtacccgaaccgtactttaccgg

SEQ ID NO: 360186 - DNA, 599 bp, Homo sapiens
  misc_feature: GZ8MTXP02FJF1N.38.1.A01.1.454.CMB.2.raw
  modified_base (196)..(196): a, c, t, g, unknown or other
  misc_feature (196)..(196): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagagccaccctctcctgcagggccagtcagagtgttagtaacaacctagcctggtaccatcagaaacctggccaggcctcccagacctcctcatctatgatgcatcccaccgaggggcccacgtcggtcgtcccccgagcccgtaaggggtttccaggttcggggccaggggttcggggttcgtgggggaaccagggtacgtttccaccttcctaccaaccctatcccaagccaagccctgccagttctagtaagtagtttttgacttagttttattagttgtactagtctaggttatgtatacgtaggtcggccctcggtacttccgtaccgttcgggacccgagggggaccacggacgtaggaaccaaaagtaaaccgacgtaggtcggactcgacaccta

SEQ ID NO: 360187 - DNA, 496 bp, Homo sapiens
  misc_feature: GZ8MTXP02FRTFK.38.1.A01.1.454.CMB.2.raw
  modified_base (194)..(194): a, c, t, g, unknown or other
  misc_feature (194)..(194): n is a, c, g, or t
  modified_base (206)..(206): a, c, t, g, unknown or other
  misc_feature (206)..(206): n is a, c, g, or t
  modified_base (354)..(354): a, c, t, g, unknown or other
  misc_feature (354)..(354): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctntcctgcagggccagtcagagtgttagaacaacctagcctggtaccatcagaaacctggccaggctccccagactcctcatctatgatgcatccaccagggccactggtgtccccagccaggtttcagtggcagtggggtctggggacngagttcactctcaccatcagcagccctgcagtctgaagattttgctagtttattattgtcagcagtatgatcagtggcctccgatcaccttcggccaggggacacgactcggacaaataaaacgaactagtcggctgcacac

SEQ ID NO: 360188 - DNA, 665 bp, Homo sapiens
  misc_feature: GZ8MTXP02GGR5R.38.1.A01.1.454.CMB.2.raw
  modified_base (285)..(285): a, c, t, g, unknown or other
  misc_feature (285)..(285): n is a, c, g, or t
  modified_base (431)..(431): a, c, t, g, unknown or other
  misc_feature (431)..(431): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgccaccctctcctgcagggccagtcagagtgttaagtaacactagcctgtaccatcaagaacctggccaggcctcccgagacctccanatctatgatgacactcccaccgagggcctagtcgggtctcccagccgtaggttcaggtcggctagggtgggtctaggggactaggtacgttccaacgttcctaccgacctatcagccaggccctgacctagtcgtagtaacgtttntttagactttaagtttactttagttagtaccttaaggtacttaagggttactaggtaaccttcggtaacgggttccgggtaccccctttacgaaccgtttaccccgtaccccgggtttaccggggacccgggttaaagggggacccctaaaccgggaacgttaacgggaaaacctaaaaacgttaaacccggaagttcggtaaccggtaccctagaacccctactacgtttccg

SEQ ID NO: 360189 - DNA, 514 bp, Homo sapiens
  misc_feature: GZ8MTXP02H8OYJ.38.1.A01.1.454.CMB.2.raw
  modified_base (349)..(349): a, c, t, g, unknown or other
  misc_feature (349)..(349): n is a, c, g, or t
  modified_base (366)..(366): a, c, t, g, unknown or other
  misc_feature (366)..(366): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctcgagggagagagccacctctcctgcagggccagtcagagtgttaagtaacaactagcctggtaccatcagaacctggccaggctccagactcctcatctatgatgcatccacagggccactggtcgtcccagccctaggttcagtcggcaggtggtcgtgggacagngttcactctcacatcancacgctgcagctagagtatttgctagtttatattgtacagtactagtatgatcagtcggcttccgatccgaccgttcggaccgtaggggaccacggactacggaactaagtaaaacgaacgtcgacggctacggaccaaccgtatccg

SEQ ID NO: 360190 - DNA, 568 bp, Homo sapiens
  misc_feature: GZ8MTXP02JHH71.38.1.A01.1.454.CMB.2.raw
  modified_base (193)..(193): a, c, t, g, unknown or other
  misc_feature (193)..(193): n is a, c, g, or t
tcagtcgatcacgtcacgaccggtgctcgatttagacgtctcatcaggggggaactgctcagttaggacccagacggaaccatggaagccccagcacagcttctcttcctcctgatactctggctcccagaaatcactggagaaatcgtgatgacgcagtctccagccaccctgtctgtgtctccgagggganagagccaccctctcctgcagggccagtcagagtgttagtaacaacctagcctggtaccatcagaacctggccaggctcccagactcctacatctatgatgcactccacgaggccagtcgggtctcccagcctaggttcaggtcggctaggtggtctgggacaggtcgttcactctaccacatcagcacgcctgacagtctagaacgttattttgacttagttttatttagttgtacagtctagttagtagattcgacggtcggtcccttacggactcccgtaacccgttccgggaccggtacgggggaccacggacgttacggaaacaaacgtaaaacgtaacgtcggtacggactcggacctaccgactttccg

SEQ ID NO: 360191 - DNA, 733 bp, Homo sapiens
  misc_feature: GZ8MTXP02G9C71.38.1.A01.1.454.CMB.2.raw
  modified_base (196)..(196): a, c, t, g, unknown or other
  misc_feature (196)..(196): n is a, c, g, or t
  modified_base (289)..(289): a, c, t, g, unknown or other
  misc_feature (289)..(289): n is a, c, g, or t
tcagtcgatcacgtcacgaccggtgctcgatttagacgtctcatcatgggggaactgctcagttaggacccagacggaaccatggaagccccagcgcagcttctcttcctcctgatactctggctcccagaaatcactggaagaaatcgtgatgacgcagtctccagcccaccctgtctgtgtcctccgagggganagacgcccaccctctcctgcagggccagtcagagtgttaagtaacaacctgcctggtaccatcaagaacctggccaggcctcccagactcctnatctatgatgacactcccgaaccgagggcccctacgtcgggtcctaccccaggcccgtaaggttcacgggttcggccgtagggttcggggtacgtaggggaaccagggttacgttccaacgtttcccgaccaaaccctattaccgaacgtacccacggtcccgttgacccgtagttaccgtaaggttaaaagttacgtttttacggaccgttttaaaggtttttaaactttgtttacggtacgttaacgggtacttaaacgggtttattaccgggtaattacggtaacggttcccggggacccctttaccggtaaacttccccggtaaaccccggtttccggggaacccggtaaacgggggacctaaacccgggtaacgtaacgggaaacctaaaacggtaaaccggtaaacgttcggtacggcgtacgaccctaaaccgttcg

SEQ ID NO: 360192 - DNA, 550 bp, Homo sapiens
  misc_feature: GZ8MTXP02JBNXQ.38.1.A01.1.454.CMB.2.raw
  modified_base (192)..(192): a, c, t, g, unknown or other
  misc_feature (192)..(192): n is a, c, g, or t
  modified_base (366)..(366): a, c, t, g, unknown or other
  misc_feature (366)..(366): n is a, c, g, or t
  modified_base (392)..(392): a, c, t, g, unknown or other
  misc_feature (392)..(392): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacactagcctggtaccatcagaacctggccaggctccagactcctcatctatgatgcactccaaccgagggccacgtggtctcccagccaggttcagtcggcaggtggtctggggacagtgttcacgtctcacntcagcagccctgcagtctagtacgtntttgacttagtttattagttgtanacgtntagttangtagtcgacggttcggtacctacggacttccgaaccgtttcgggaccgtaggggacctacggtacgtacggaaaactaacgtaaaacgaacgttaggtacggactggacctacgtacttccg

SEQ ID NO: 360193 - DNA, 600 bp, Homo sapiens
  misc_feature: GZ8MTXP02F6K94.38.1.A01.1.454.CMB.2.raw
  modified_base (192)..(192): a, c, t, g, unknown or other
  misc_feature (192)..(192): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccagggganagacgcccaccctctcctgcagggccagtcagagtgttagtaacaacctagcctggtaccatcaagaacctggcccaggcctcccagactcctcatctatgatgcatcccaccgaggccagtggctcccagccaggttccaggtcggctaggtggggtctggggacagtcgttccacttctaccacctatcagacacgccctgaccagttcgtagtaacgtattttcgacttagtttaatttacttgtacgtagtactagttagtagtactgtacggtcggtaccctaccgtactaccgtaacccgtttcgggacccggtacgggggacctacggtaaccgtacgggaaaacctaaacgtaaaaccggaacgttcggtacggtacctacggacccgacctacttaccg

SEQ ID NO: 360194 - DNA, 565 bp, Homo sapiens
  misc_feature: GZ8MTXP02F8DLX.38.1.A01.1.454.CMB.2.raw
  modified_base (191)..(191): a, c, t, g, unknown or other
  misc_feature (191)..(191): n is a, c, g, or t
  modified_base (425)..(425): a, c, t, g, unknown or other
  misc_feature (425)..(425): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccacccctctcctgcagggccagtcagagtgttaagtaacaacctagcctggtaccatcaagaacctggcccaggcctcccagacctcctcatctatgatggcactcccaccgaggggccccacgtcgggtctaccccgaggccctaagggttcaggtcggactagggtcgggtctggggaacagggtagttccactctacaccatcagcagcctgcagtctagaagttnttttgacttagtttattagttcgtctagtctagtatgtatcgtagtcggtcctaccgatccgtaacgttcggacggagggtaccacgtacgtacggaaccaaagtaaaccgtaagtgtacggactcgacctacgtattcg

SEQ ID NO: 360195 - DNA, 547 bp, Homo sapiens
  misc_feature: GZ8MTXP02I997X.38.1.A01.1.454.CMB.2.raw
  modified_base (195)..(195): a, c, t, g, unknown or other
  misc_feature (195)..(195): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (406)..(406): a, c, t, g, unknown or other
  misc_feature (406)..(406): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctctgtctccgagggganagacgccaccctctcctgcagggccagtcagagtgttaagtaacaacctgcctggtaccatcagaacctggccaggcctcccagacctcctcatctatgatgcatcccacgagggcctacgtggtcgtcccagcctaggttcaggtgcaggtgggtcngggacnggtgttcactctcacatcagcacgcctgctagtctagtaaacgtttntttgactttagtttaattagttgtacgtagtactagttatgtatacgtaggtcggtcctacgtactccgtaccggttcggaccggacgggtaccacggtacgtacgaactaaacgtaacgacgtgtacgactcgactacta

SEQ ID NO: 360196 - DNA, 582 bp, Homo sapiens
  misc_feature: GZ8MTXP02GX1UB.38.1.A01.1.454.CMB.2.raw
  modified_base (192)..(192): a, c, t, g, unknown or other
  misc_feature (192)..(192): n is a, c, g, or t
  modified_base (278)..(278): a, c, t, g, unknown or other
  misc_feature (278)..(278): n is a, c, g, or t
  modified_base (373)..(373): a, c, t, g, unknown or other
  misc_feature (373)..(373): n is a, c, g, or t
  modified_base (413)..(413): a, c, t, g, unknown or other
  misc_feature (413)..(413): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcgacgggccagtcagagtgttaagaacactagctaggacatcagaactggccaggcctccagcctcncatctatgatgcactcccgacacgggcctacgtcgggtctcccgagccgtaaggttcaggtcggcgaggttgggtcgtagggacaggtacgttcnctctaccacatcagccagcctgactagtctagaacgtttnttagacttatttattattgtactagtatagtatacgtatcgtacgtccggtacctacgtacctacccgttaccggtaccgggaccggtaacgggaaacctacggaaacgtaacgtaaaaccgtaaacgtaaacgtaaggttcgacggtacctacgacctacgtactccg

SEQ ID NO: 360197 - DNA, 560 bp, Homo sapiens
  misc_feature: GZ8MTXP02I5A58.38.1.A01.1.454.CMB.2.raw
  modified_base (193)..(193): a, c, t, g, unknown or other
  misc_feature (193)..(193): n is a, c, g, or t
  modified_base (396)..(396): a, c, t, g, unknown or other
  misc_feature (396)..(396): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagaacacctagcctggtaccatcaagaacctggccaggctcccagacctcctcatctatgatgcactcccaccgagggcccacgtggtcgtcccagccaggttcagtcggcagtgggtctgggacagtgttcactctcactatcagcagcctgcagtctagaagttnttttgctagtttattagttgtacagtactaggttatagtattccgaggttcgggtacctccggtaatcccgtaaccgttccgggaccgtaacgggggacctaccggacgtacgggaaactaaacgtaaaaccgaacgtggtacggctacggacacctacttacg

SEQ ID NO: 360198 - DNA, 699 bp, Homo sapiens
  misc_feature: GZ8MTXP02F8TGG.38.1.A01.1.454.CMB.2.raw
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctcctgcgacgggccagtcagtagtgttaagtaacaccgtagcctaggtaccatcaacgaacctggaccaggcctcccgagtaccctcctacattctatgatcgacactacccaaccgcgggccctacgttcgggtccctaccccgacggtcccgtaggttcgaggtccgggacgtaggggttcggggtccgtaggggaactagggtcgtttccaaccttcctaccacctagaccgacgccgtacgccgtagacttagtacgtaaggtaacgtttcgtttagtactttaagttttattagttacgtactaagtacgtagttacgtagtacgtacggtaggtcccgtaccctaccgtacgttacccgttacccgggtacgggaaccgggtaacgggtaaccctaacgggtaacgtaaacggaaaaacctaaaaccggttaaaacggtaaccggttcgggaacgtaccgtaaccgtacctaaccgttacgtttcg

SEQ ID NO: 360199 - DNA, 734 bp, Homo sapiens
  misc_feature: GZ8MTXP02IVYHB.38.1.A01.1.454.CMB.2.raw
  modified_base (194)..(194): a, c, t, g, unknown or other
  misc_feature (194)..(194): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtcctccagccaccctgtctgtgtctccgagggganagacgcccaccctctcctgcgagggccagtcagtagtgttaagaacaactagcctaggtaccatcaacgaaaccgtggccaggcctacccgagacctcctcatctatgatcgactactacccgaaccgcgggacccacgttgggtcctacccacggtcctaaggttccaggtcggacgtaggggttcgggtacgtaggggaacctaggtacggtttcctaccgttcctacccaaaccgtcgtaccgaacggccctaacggcccgttacggaccgtacggttaccgttaagttaaaggttttccttttttagggaacctttttaaggtttttaacttttaaggtttagttacccgtaaaggttactaaggtttaaagtcgttaacgtccgttaaggggttcccgtaccccgtttaccggactttaccccggacccggtttaccggggacccggtaacgggggaaaccctaacgggtaacgttaaccggaaaactaaaacgttaaaccgaagttcggacgtactacgaccaacgttcttacg

SEQ ID NO: 360200 - DNA, 656 bp, Homo sapiens
  misc_feature: GZ8MTXP02G4YEF.38.1.A01.1.454.CMB.2.raw
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccacccctctcctgcagggccagtcagagtgttaagaacacctgcctggtaccatcaagaaacctggaccaggcctcccagacctcctcatctatgatgcatcccaccgagggcctacgtcggtcgtccccacggcctagggttcgagtccggcgaggttggggtcgtggggaacaggtcgttaccacttcctaccaacctactcaacggccaacggtccctacggcctaagttaccgtaggtaaacggttatttttaggactttaggttttatttaagtttcgttacgaacgtagaaggtttatacgtaacttccgtaaggttcggccctttacccggaacttcccgtaaccccggtttacggggaccccggtaaagggggacccaaacgggtacgtacgggaaaaacctaaggtaaaacccgtaagttggtacggtctacgtaccaactactttcc

SEQ ID NO: 360201 - DNA, 552 bp, Homo sapiens
  misc_feature: GZ8MTXP02IXBCC.38.1.A01.1.454.CMB.2.raw
  modified_base (194)..(194): a, c, t, g, unknown or other
  misc_feature (194)..(194): n is a, c, g, or t
  modified_base (280)..(280): a, c, t, g, unknown or other
  misc_feature (280)..(280): n is a, c, g, or t
  modified_base (317)..(317): a, c, t, g, unknown or other
  misc_feature (317)..(317): n is a, c, g, or t
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
  modified_base (394)..(394): a, c, t, g, unknown or other
  misc_feature (394)..(394): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccacctgtctgtgtctccgagggganagagccaccctctcctgcagggccagtcagatgttagaacacctgcctggtaccatcagaaacctggccaggctcccagacctccnatctatgatgcactcccacgagggccctacgtggtcnccccagcctaggttcagtggcaggtggtctgggacnggnttcactctcacatcagnacgctgcagtctagtaagttntttgattagtttattattgtacagtcgtagtatgtatcgtagtcggccttaccgtacttaccgtaaccggttacgggaccggaacggggaccaacggtaacgtaacgaaactaaaacgtaaacggtaacgtggtacggtacgtacgaccgtaacctag

SEQ ID NO: 360202 - DNA, 588 bp, Homo sapiens
  misc_feature: GZ8MTXP02JEV69.38.1.A01.1.454.CMB.2.raw
  modified_base (196)..(196): a, c, t, g, unknown or other
  misc_feature (196)..(196): n is a, c, g, or t
  modified_base (290)..(290): a, c, t, g, unknown or other
  misc_feature (290)..(290): n is a, c, g, or t
  modified_base (482)..(482): a, c, t, g, unknown or other
  misc_feature (482)..(482): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgcccaccctctcctgcgagggccagtcagagtgttagaacaactagcctggtaccatcaagaaacctggccaggcctcccagacctcctnatctatgatgcactcccacgacgggcccacgtcggtctccccagtccccgtaagggttcagggtcggcagggtcggggtcaggggaactagggtacgtttccacttccgacaacccagttccaacgcacggtccctaggcctagttacctaggaaagttgttttgacttagttttaattagttcgtacagtntaaggtatgatcgagtcgcctcgatccgtaccgttcggacgacggggaacaccggaagtacggaaactaaacgaaacgtacgtggtacggctacgaccctataacg

SEQ ID NO: 360203 - DNA, 682 bp, Homo sapiens
  misc_feature: GZ8MTXP02ILR3C.38.1.A01.1.454.CMB.2.raw
  modified_base (490)..(490): a, c, t, g, unknown or other
  misc_feature (490)..(490): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctcctgccagggccagtcagtagttgttaagtaaaccaacctagccctagggtaacccataccaacggtaaaacctgaacccaggcctaccccaagacctcctcatctatgatcgcactacccacgacgggccctagtggtcctaccccagcctaaggttccaggtcggcgtagggttcggggtactcggggaactagggtacgtttacaacccgttcctacccgaacctagtaccgagtccaacggtccctaggaccgttaacgtcgtaaggtaaagtttnttttcggactttaagtttttaaatttacgttttagacgtaagttccgtaaagttagtaggtaattccgtaagggtccggtacccttacgtacgtacccgttacccgttacgggacccggtaaggggaacccaacggtacgtaacggaaacctaaaaggtaaacgtacgtggtacggactcgacctaacgtac

SEQ ID NO: 360204 - DNA, 532 bp, Homo sapiens
  misc_feature: GZ8MTXP02IKUUM.38.1.A01.1.454.CMB.2.raw
  modified_base (194)..(194): a, c, t, g, unknown or other
  misc_feature (194)..(194): n is a, c, g, or t
  modified_base (280)..(280): a, c, t, g, unknown or other
  misc_feature (280)..(280): n is a, c, g, or t
  modified_base (352)..(352): a, c, t, g, unknown or other
  misc_feature (352)..(352): n is a, c, g, or t
  modified_base (398)..(398): a, c, t, g, unknown or other
  misc_feature (398)..(398): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacacctagcctggtaccatcagaacctgccaggcctccagactccncatcatgatgcactcccaccagggccacgtggtctcccagccaggttcaggtggcaggtgggtctggggacnggtacgttcacgtctaccacatcagcacgcctgacagtcagtattnttgattagtttatntnctagtatagtatagtatgtacgctcctacgtactccgtacgtcggacggacggtacacggtacgaacgtaactaaaacgtaaccgtaagtcggtacggtactccgaacctacgttacg

SEQ ID NO: 360205 - DNA, 758 bp, Homo sapiens
  misc_feature: GZ8MTXP02ITUJZ.38.1.A01.1.454.CMB.2.raw
  modified_base (192)..(192): a, c, t, g, unknown or other
  misc_feature (192)..(192): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccacccctctcctgcagggccagtcagtagtgttagaacaacctgcctggtaccatcagaaacctggcccaggcctcccagacctcctacatctatgatgacactcccaaccgcgggcccacgttcgggtctccccagcccgtaggttcaggtcggcgtagggtcggggtacgtggggaacctaggtccggtttaccaccgttcctacccgaaacctacgtaccgaggaccctacgtccccgttaggacccgtaaggtttcccgttaaagggtaaacgtttagttttttacgggtaactttagggttttttaaacttttagtttacggttaccgtaacggttaacgttaagggttactttaggtaacgtaccggttaacggttcccgggtaaccccgtttaccgtaaaccgttcccccgttaaaccccgggtttcccgggggaacccggttaacgggggaaaccctaaacccggggacgtttaacgggaaaaaccttaaaaccgtaaaaccgggaaccgtttggacgggttaccaccggtacctaaccgttacgtttccg

SEQ ID NO: 360206 - DNA, 697 bp, Homo sapiens
  misc_feature: GZ8MTXP02JTF2I.38.1.A01.1.454.CMB.2.raw
  modified_base (271)..(271): a, c, t, g, unknown or other
  misc_feature (271)..(271): n is a, c, g, or t
  modified_base (301)..(301): a, c, t, g, unknown or other
  misc_feature (301)..(301): n is a, c, g, or t
tcagtcgatcacgtcacgaccggtgctcgatttagacgtctcatcagggggaggaactgctcagttaggacccagacggaaccatggaagccccagcgcagcttctcttcctccttgatactctggctcccagaaatcactggagaaatcgtgatgacgcagtctccagccaccctgtctgtgtctccgaggggagagagcccaccctctcctgcagggccagtcagagtgttagaacaactgcctggaccatcagaacctggccaggccncccagcctctcatctatgatgcatccacgngggccacgtggctcccagtccctaggttcacggtcggactagggttcggggtactggggaactggtacgttccgaaccttctaccgaaccctatccaacgcccaacgtcccgtggcctaacgttcctaggtaaacggtttacgtttttcggaccgtttaaggtttttaactttagtttacggtacgtaagggtacccgttaagggttaacttagggtaactttacggaacgggtttccgggtcccccttaaccgggtaaccgttcccgttaacccccggtttaccggggaccccggttaacgggggaaccctaacccgggtaaaccgtcgggaaaaccttaaaacgtaaaacccggtaacgttcggtaccgggacttaccggacctaacccgtacg

SEQ ID NO: 360207 - DNA, 514 bp, Homo sapiens
  misc_feature: GZ8MTXP02GI4DO.38.1.A01.1.454.CMB.2.raw
  modified_base (195)..(195): a, c, t, g, unknown or other
  misc_feature (195)..(195): n is a, c, g, or t
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (347)..(347): a, c, t, g, unknown or other
  misc_feature (347)..(347): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (417)..(417): a, c, t, g, unknown or other
  misc_feature (417)..(417): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagaacactgcctgtacatcagaaccnggccagctcccanactcctcatctatgatgcactccaccagggccactggtcgtccccagccaggttcagtggcaggtgggtctgggacngtgtcactctcacatcagcagctcgnagtcngaaatntttgctagtttattatgtacagctaagtatgancgtagtcggccctcgatccgtacccttcgggaccgacgggggaactacggaactaggaaccaaagtaaaaccggaatgtacgggctagcctacgtac

SEQ ID NO: 360208 - DNA, 564 bp, Homo sapiens
  misc_feature: GZ8MTXP02HSHWL.38.1.A01.1.454.CMB.2.raw
  modified_base (228)..(228): a, c, t, g, unknown or other
  misc_feature (228)..(228): n is a, c, g, or t
  modified_base (293)..(293): a, c, t, g, unknown or other
  misc_feature (293)..(293): n is a, c, g, or t
  modified_base (307)..(307): a, c, t, g, unknown or other
  misc_feature (307)..(307): n is a, c, g, or t
  modified_base (367)..(367): a, c, t, g, unknown or other
  misc_feature (367)..(367): n is a, c, g, or t
  modified_base (419)..(419): a, c, t, g, unknown or other
  misc_feature (419)..(419): n is a, c, g, or t
  modified_base (436)..(436): a, c, t, g, unknown or other
  misc_feature (436)..(436): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctcctgcagggccagtcagngtgttaagtaacaactagcctggtaccatcaagaacctggctaggcctcccagctcctcatctangatgcatcccacgngggccagtggtctcccagtcccgtaggttccaggtcggcgtaggtggggtctaggggacnggtacgttcacgttctacacctatccagcacgcctgctagtctagtaagttntttgacttagtttattnttgtcgagtctagttatgatcgaggtcgtcccttacgacttccgtaccgttcgggacccgtaaggggacctaacggactacggaaaccaaagtaaaaccgacgtggtacggactcggacctaaccgta

SEQ ID NO: 360209 - DNA, 576 bp, Homo sapiens
  misc_feature: GZ8MTXP02HT9B7.38.1.A01.1.454.CMB.2.raw
  modified_base (377)..(377): a, c, t, g, unknown or other
  misc_feature (377)..(377): n is a, c, g, or t
  modified_base (431)..(431): a, c, t, g, unknown or other
  misc_feature (431)..(431): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctcctgcgagggccagtcagagtgtagtaacactgcctgtaccatcaagaacctggaccaggcctcccgagacctcctcatctatgatgacactccaccgcgggaccacgttcggtctccccgagtccccgtaggttccaggtcggcgtagggtcggggtctggggacnggtacgtttcacctcctacaccatccagcacgcctagcctagttcagtaagttntttagactttaagtttatttagttgtactagtacgtagttatgactacgtcggtagtcccctacggtactccgtaccgttcgggaccggtaacgggctaacgacgtacgaaactaagtaaaccgagtcgtcgacgtcgactactg

SEQ ID NO: 360210 - DNA, 682 bp, Homo sapiens
  misc_feature: GZ8MTXP02F13QL.38.1.A01.1.454.CMB.2.raw
  modified_base (195)..(195): a, c, t, g, unknown or other
  misc_feature (195)..(195): n is a, c, g, or t
  modified_base (227)..(227): a, c, t, g, unknown or other
  misc_feature (227)..(227): n is a, c, g, or t
  modified_base (285)..(285): a, c, t, g, unknown or other
  misc_feature (285)..(285): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcagggccagtcagngtgttagaacactagcctggtaccatcagaaacctggccaggcctcccagacctcctnatctatgatgctatcccaacgaggcccacgtggtcgtccccagcctaaggttcaggtggcaggttcgggtctaggggacctaggggtacgtttcaaccgttcctacccgaaaccctagttaccgaaacggtcccaacggtccccgttaggacccgttacggtaccgttaggtaaaagtttactttttggaactttaggttttaatttagtttcggtacgtagtctaaagggttataggtacttacgtaacgggttcggacccctaccggtacttcccgtaacccggtttacgggacccgggtaaacggggaaccctaaacgggtaccgttaacgggaaaacctaaaacgtaaaaaccggtacgtacgggtacggaccttacggacctaacccttaag

SEQ ID NO: 360211 - DNA, 533 bp, Homo sapiens
  misc_feature: GZ8MTXP02HWL2T.38.1.A01.1.454.CMB.2.raw
  modified_base (195)..(195): a, c, t, g, unknown or other
  misc_feature (195)..(195): n is a, c, g, or t
  modified_base (319)..(319): a, c, t, g, unknown or other
  misc_feature (319)..(319): n is a, c, g, or t
  modified_base (357)..(357): a, c, t, g, unknown or other
  misc_feature (357)..(357): n is a, c, g, or t
  modified_base (407)..(407): a, c, t, g, unknown or other
  misc_feature (407)..(407): n is a, c, g, or t
  modified_base (422)..(422): a, c, t, g, unknown or other
  misc_feature (422)..(422): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcagggccagtcagagtgtagtaacactagcctggtaccatcagaacctggacccaggcctcccagacctcctcatctatgatgcatcccacagggcccagtggtcncccagcccaggttcagtggcaggtggggtctggggacnggtacgttccacgtcctcacctatccagcacgcctgcagtctagtaagtntttggcttaagtttntttagttgtctagctagtatgatcgagtcggccctcgattcccgaccgttccggaccgagggaccaacgcgtacggaacaaagtaaaacgacgtgtacgctacgactacta

SEQ ID NO: 360212 - DNA, 604 bp, Homo sapiens
  misc_feature: GZ8MTXP02I1WL9.38.1.A01.1.454.CMB.2.raw
  modified_base (194)..(194): a, c, t, g, unknown or other
  misc_feature (194)..(194): n is a, c, g, or t
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
  modified_base (312)..(312): a, c, t, g, unknown or other
  misc_feature (312)..(312): n is a, c, g, or t
  modified_base (419)..(419): a, c, t, g, unknown or other
  misc_feature (419)..(419): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctccagaaatcactggagaaatcgtgatgacgcagtctccagccaccctgtctgtgtctccgagggganagagcccaccctctcctgcgacgggccagtcagagtgttagaacacctgcctgaccatcagaaccngcagcnccagacctccnatctatnatcgcatcccacgacggccacgtggtcncccgagtcctaggttcaggtggctagggtcgggtctaggggactaggtacttcaccgttcctaccaacctatccgacgcacgtccctagctagttcgaggtaagttnttttagactttaagttttaattagtttcgtactagtacgtaaggttatagtactacgtacgtcggtacccctacgacttcccgtaaccggttccgggacccggtaaacggggacccaacggtacgtaacgggtaaacaaaacggtaaaccgtaacgtcggtacggaccgttcggacctaactacg

SEQ ID NO: 360213 - DNA, 547 bp, Homo sapiens
  misc_feature: GZ8MTXP02J2JYH.38.1.A01.1.454.CMB.2.raw
  modified_base (193)..(193): a, c, t, g, unknown or other
  misc_feature (193)..(193): n is a, c, g, or t
  modified_base (211)..(211): a, c, t, g, unknown or other
  misc_feature (211)..(211): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (444)..(444): a, c, t, g, unknown or other
  misc_feature (444)..(444): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctccngcgagggccagtcagagttagttaagtaaccaacctagccctaggtacccatacaagaaacctggacccaggcctaccccgagacctcctcatctatgatgcactccacgagggcctacgtggctcccagccctaggtcaggtcgcaggtgggtcagggacagtcgtcactctacacctatcagcacncngcagtctagaagtatttgacttagtttattacgttgtacagtntagtatagatcgtagtacggtcctacgtataccgtcgttccggacgacgggaccaacgacgacgaacaaagaaaccgtaagtaggtacgctacgacactatcg

SEQ ID NO: 360214 - DNA, 627 bp, Homo sapiens
  misc_feature: GZ8MTXP02JLOFD.38.1.A01.1.454.CMB.2.raw
  modified_base (193)..(193): a, c, t, g, unknown or other
  misc_feature (193)..(193): n is a, c, g, or t
  modified_base (479)..(479): a, c, t, g, unknown or other
  misc_feature (479)..(479): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagtagtgttaagaacaactagcctaggtaccatcaagaaccctggaccaggcctacccagacctcctacatctatgatgacactcccgaccgagggtccacggtgggtccgtcccaggtcctaggttcaggtccggcagggttcgggtctggggaacaggtcgttccaacttcctaccaacctagtccagaccacggtccctgaccgtagttacgtagtaaggttatttttcggattaagttttacttagttcgtanaggtactaaggttatagtacttcgacggttcggaccttaccggacttaccgacccggttccggggaccgtaacgggggaaccacgggtaacgtacggaaaactaacgtaaaaccgtaacgtggtaccggactacgaccactactttcg

SEQ ID NO: 360215 - DNA, 638 bp, Homo sapiens
  misc_feature: GZ8MTXP02FO64Y.38.1.A01.1.454.CMB.2.raw
  modified_base (282)..(282): a, c, t, g, unknown or other
  misc_feature (282)..(282): n is a, c, g, or t
  modified_base (448)..(448): a, c, t, g, unknown or other
  misc_feature (448)..(448): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagcccaccctgtctgtgtctccgaggggagagagcccaccctctcctgcagggccagtcagagtgttaagtaacacctagcctggtaccatcagaacctggccagctccagacctccnatctatgatgcactcccgaaccgacggggcccacgttcgggtcgtaccccaaggcccgtaagggtttcaggtcgggacctagggttcggggttcctaggggaactagggtcgtttccaccgttctaccaacccaatccgagcagtccctgactaggtctagaagtnttttgacttagtttattattcgactagtctaagtatacgaattcgaaggttcggtaccctccggtaactcccgtaaccccggttccggggacccggaaagggggaccaaccgggaacgttaccggaaaaccgtaaacgtaaaaaccggtaacgttagggtacggacttacggacctaaccctagtttccg

SEQ ID NO: 360216 - DNA, 650 bp, Homo sapiens
  misc_feature: GZ8MTXP02IMG9A.38.1.A01.1.454.CMB.2.raw
  modified_base (333)..(333): a, c, t, g, unknown or other
  misc_feature (333)..(333): n is a, c, g, or t
  modified_base (449)..(449): a, c, t, g, unknown or other
  misc_feature (449)..(449): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctcctgcagggccagtcagagtgttaagtaacaacctagcctggtaccatcaagaaacctggccaggcctcccagacctcctcatctatgatgaccactcccaccgagggccctacgtcggtccncccccgagcccgtaggtttccagggtcggccgtaggggttcggggtcgtaggggactagggtacgtttccaccttccgtaccaccatccgagcacgcctgctagtctagtaagttntttgactttaagtttttatttagtttcgtacgtagtacgtagtaagtgtaattcgaggtccggtcccttaccgtacttcccgtaccggttaccggggacccggtaacgggggtaaccctaacggtaccgtaacggaaaccttaaaacggtaaaaccggtacgttacgggtacgggtacctacgggaccctaacccgttacg

SEQ ID NO: 360217 - DNA, 570 bp, Homo sapiens
  misc_feature: GZ8MTXP02FPA5T.38.1.A01.1.454.CMB.2.raw
  modified_base (195)..(195): a, c, t, g, unknown or other
  misc_feature (195)..(195): n is a, c, g, or t
  modified_base (285)..(285): a, c, t, g, unknown or other
  misc_feature (285)..(285): n is a, c, g, or t
  modified_base (373)..(373): a, c, t, g, unknown or other
  misc_feature (373)..(373): n is a, c, g, or t
  modified_base (394)..(394): a, c, t, g, unknown or other
  misc_feature (394)..(394): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagccaccctctcctgcagggccagtcagagtgttagtaacaacctagcctggtaccatcagaacctggccaggctcccagacctcctnatctatgatgcatccccaaccgaggggccccagtcggtcgtccccaagcctagggttccaggtgcctagggtcggggtcagggggacnggtcgttcacttcctcaaccntcaacgcacgctcggcagtctaggtaattagttttagacttaagttttatttagttagttacgtagtcttaaggttatagtatacgtagtcggacctccgtactaccgtaccgttcggaccgacggggactacggacgtacggaacaaacgtaacgactagacggctacgcactac

SEQ ID NO: 360218 - DNA, 576 bp, Homo sapiens
  misc_feature: GZ8MTXP02IICGB.38.1.A01.1.454.CMB.2.raw
  modified_base (196)..(196): a, c, t, g, unknown or other
  misc_feature (196)..(196): n is a, c, g, or t
  modified_base (287)..(287): a, c, t, g, unknown or other
  misc_feature (287)..(287): n is a, c, g, or t
  modified_base (359)..(359): a, c, t, g, unknown or other
  misc_feature (359)..(359): n is a, c, g, or t
tcagtcgatcacgtcacgaccggtgctcgatttagacgtctcatcagggggaggaactgctcagttaggacccagacggaaccatggaagccccagcgcagcttctcttcctcctgactactctggctcccagaaatcactggagaaatcgtgatgacgcagtctccagccaccctgtctgtgtctccgagggganagagccaccctctcctgcagggccagtcagagtgttaagtaacaactagcctggtaccatcaagaaacctggccaggcctccagacctccnatctatgatgcactccacgagggcccagtggtctcccagccaggttcaggtggcaggtgggtctggggaacnggtagttcacttcctaccacatcagcagcctgctagtctaggaaagttgttttgacttaagtttttatttagttcgttacgagtactaaggttatggacttacgtaggtcggtacccttcgtactcccgtaccgttccgggaccgaacggggaccaacggacgtaacggaaactaaacgtaaaaccgtacgtcggtacggactcggacctacctacg

SEQ ID NO: 360219 - DNA, 556 bp, Homo sapiens
  misc_feature: GZ8MTXP02GC4ZX.38.1.A01.1.454.CMB.2.raw
  modified_base (191)..(191): a, c, t, g, unknown or other
  misc_feature (191)..(191): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttaagtaacacctagcctaggtaccatcagaaacctggccaggctcccagactcctcatctatgatgcatcccaccagggccacgtgggtctcccagccgaggttcaggtggcaggtgggtctggggacagtgttcnctcncaccatcagcagccctagcagtctagaagtatttgactagtttattagttgctaaggctaagttatgatcgtagtcggacccttccgattcccaaccgttccggaccggagggggaaccacggtaacgtacggaaaacctaaaacgttaaaaccgaacgtggttacggctaccgactacccgtatttccg

SEQ ID NO: 360220 - DNA, 571 bp, Homo sapiens
  misc_feature: GZ8MTXP02IRVGZ.38.1.A01.1.454.CMB.2.raw
  modified_base (194)..(194): a, c, t, g, unknown or other
  misc_feature (194)..(194): n is a, c, g, or t
  modified_base (289)..(289): a, c, t, g, unknown or other
  misc_feature (289)..(289): n is a, c, g, or t
  modified_base (389)..(389): a, c, t, g, unknown or other
  misc_feature (389)..(389): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaatcgtgatgacgtagtctccagccaccctgtctgtgtctccgagggganagagccacctctcctgcagggccagtcagagtgttagaacacctagcctggtaccatcagaacctggccaggctacccagacctcctacatctangatgcatcccaccgagggcccacgtgggtactcccaggtcctaggttcaggtcggctaggttggggtactgggacagcgttcacttctaccacatcagcngcctgacagtctagagttagtttgacgttagttacttagttgtactacgtctagttatgtattcgaggtcgtaccgttccgataccgtacccgttcgggaccggtacggggactaacggtaccggtagaaaccgtaaacgtaaaacgtaacgtaggttacgcgtacgacctacgtatttccg

SEQ ID NO: 360221 - DNA, 605 bp, Homo sapiens
  misc_feature: GZ8MTXP02GL05Y.38.1.A01.1.454.CMB.2.raw
  modified_base (195)..(195): a, c, t, g, unknown or other
  misc_feature (195)..(195): n is a, c, g, or t
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (302)..(302): a, c, t, g, unknown or other
  misc_feature (302)..(302): n is a, c, g, or t
  modified_base (572)..(572): a, c, t, g, unknown or other
  misc_feature (572)..(572): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctccagaaatcactggagaaatcgtgatgacgcagtctccagcccaccctgtctgtgtctccgagggganagagcccaccctctcctgcagggccagtcagagtgtagaaccactgcctggaccatcagaaccnggccagctcccanacctcctcatctatgatgacactcccacgngggcccagtggtccgtcccagcctaggttcaggtcggctaggtcggggtctaggggaacagggtacttccgaccttcctaccaaccatccagacccacggtccctaggactagttcgaggtaaagttacgttttgactttaaggtttttaatttagttacggtacacgtataagttagtacggattcgtacggtacggtcctaaccgattccccgtaccggttacgggaccgtacggggaaacctacgggacgtacggaaaccttaaaanaaaccggtagtggtcgacgtagacccacgtacg

SEQ ID NO: 360222 - DNA, 661 bp, Homo sapiens
  misc_feature: GZ8MTXP02G58T7.38.1.A01.1.454.CMB.2.raw
  modified_base (195)..(195): a, c, t, g, unknown or other
  misc_feature (195)..(195): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcagggccagtcagagtgttaagtaacaacctagcctggtaccatcagaacctggccaggcctcccagacctcctcatctatgatcgctactcccaccgagggtcccacgttcggtccgtacccccgaggcccgtaggttccagggtcggacgtaggggtcggggtcgtaggggaacctagggtacgtttacaccttcctaccaccataccgagaccacgtcccgtgaccgtagttacgtaggtaaagtttagttttacgactttaagtttttaaatttgttacgttacgtaggtacttaaggttatacggtaacttcgtaggttccggtacccttacgtaacttcccggtaacccgttccgggaccggtaaccggggaccaccggtacgtaaccggaaactaaaacgtaaacggtacgtggtaccggtacctcgaccctacttaccg

SEQ ID NO: 360223 - DNA, 702 bp, Homo sapiens
  misc_feature: GZ8MTXP02H6UOI.38.1.A01.1.454.CMB.2.raw
  modified_base (195)..(195): a, c, t, g, unknown or other
  misc_feature (195)..(195): n is a, c, g, or t
  modified_base (286)..(286): a, c, t, g, unknown or other
  misc_feature (286)..(286): n is a, c, g, or t
  modified_base (301)..(301): a, c, t, g, unknown or other
  misc_feature (301)..(301): n is a, c, g, or t
tcagtcgatcacgtcacgaccggtgctcgatttagacgtctcatcagggggagaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgcccacccctctcctgccgagggccagtcagtagtgttagtaacaacctagcctggtaccatcaacgaactggccaggcctacccanacctcctcatcctangatgcactacccacgacgggccctacgtggtccgtacccgacgtcccgtagggttcctaggggtacgtcgtacgggtcggggtcgtacgggggactagtaccggtttaccaaccgttctaccgacccaaattcaaccgtcaggtaccccgtgaccctagttcgtaagtaagtttactttacgacgtttaagttttatttactttggtacctaggtctaagtaagtttgaaacttacgtagggttaccgtcccgttaccgtaacttcccccgtaacggtttaccccgggaccggaacgggggtaaaccctaccggtaaccggtaaacgtaaacccggtaaaaagtaaaaccccgggtaagtccggggttaggtaccggtacccaaaccggtaccttaacccg

SEQ ID NO: 360224 - DNA, 739 bp, Homo sapiens
  misc_feature: GZ8MTXP02HURK0.38.1.A01.1.454.CMB.2.raw
  modified_base (192)..(192): a, c, t, g, unknown or other
  misc_feature (192)..(192): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcagggccagtcagtagtgttagaacactgcctggaccatcaacgaacctggccaggcctacccagtacctcctacatctatgatcgaccacgtcccaaccgaggggacccctacgttcggggttccgtaccccgaacggtcccgttaacggggtttccgaacgggttccggggacccgtaggggtttcgggggttccgtagggggaaccctaagggttaccggtttccacccttccctacccctaaacccgtataccgaacggcccgaaccgtccccgttaggaccgtaaggttccgttaaggtaaagtttacgtttttacggactttaagtttttatttaagttttcgtacgtaagttactaggttagtgtaagtaccgtaaggttccggaccttaccggtaacttcccgtacccggttaaccggggacccggtacggggaacctaaccgggaccgttaacggaaaacccgtaaaagtaaaccgaacgtttcggacggtacgtacgtaacccgacctagtttacccg

SEQ ID NO: 360225 - DNA, 784 bp, Homo sapiens
  misc_feature: GZ8MTXP02H2WGC.38.1.A01.1.454.CMB.2.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagacgcccaccctctcctgcagggccagtcagagtgttagtaacactagcctgaccancagaacngcagctccagctcncatctatgatcgacactcccaccgagggccacgtcggtcgtcccaagccgtaggttcaggtcggcgtagggttcggggtactaggggaactaggggtacgtttaccaacccgttccgtaaccctaaacccgtagttacccggaaacgtacccgaaacggtcccccgttacggacccgttaacgggtttacccgtaaacgggttaaaaggttttacgtttttacggaccgtttttaaagggtttttttaacttttaaaggttttcggtaaccgttaaaggttaacgttaaaggtttagttagtaaacgttcggttaaacgggttccgggttacccccttaccgggtaaccttaccccggttaccccggtttaccggggacccgggtaaacgggggttaaacccgaaaccgggttaaccgaacgggtaaaacccgttaaaaacggttaaaaacccggtaaccggttaggggttaccgggtaccttaacccgggacccttaaacccgtttacg

SEQ ID NO: 360226 - DNA, 721 bp, Homo sapiens
  misc_feature: GZ8MTXP02I29I6.38.1.A01.1.454.CMB.2.raw
  modified_base (267)..(267): a, c, t, g, unknown or other
  misc_feature (267)..(267): n is a, c, g, or t
tcagtcgatcacgtcacgaccggtgctcgatttagacgtctcatcagggggaggaactgctcagttaggacccagacggaaccatggaagccccagtgcagcttctcttcctcctgatactctggctcccagaaatcactggagaaatcgtgatgacgcagtctccagcccacctgtctgtgtctccgaggggagagacgccacctctcctgcgagggccagtcagtagtgttaagtaaccaacctagcctagtaccatcagaaccnggccaggcctcccagacctcctacatctatgatcgacactcccacgcgggcctacgtcggtccgtccccgagtcccgtaaggttccgaaggtcggacgtaggggttcggggtcgtacggggaactagggttacgtttccaacgttcccgtaccaaccgtaattccgacgcctacgtcccgtgacgttacgtacgtaggtaaacgtttagttttacgacgtttaagttttaatttaacggtttacgtaccgttaggttactaacgttaacgtagtaacgttccgtaagggttccgggtaaccccttccgtaccgttaccccgttaaccccggttccggggaacccggtaaacgggggtaaaccctaaccggtaaaccgaaacgggtaaacctaaaaaacggtaaaacccggtaacggttacggtaacggtccgtacggaaccctaacgtttaccg

SEQ ID NO: 360227 - DNA, 729 bp, Homo sapiens
  misc_feature: GZ8MTXP02I7ZL4.38.1.A01.1.454.CMB.2.raw
  modified_base (193)..(193): a, c, t, g, unknown or other
  misc_feature (193)..(193): n is a, c, g, or t
tcagtcgatcacgtcacgaccggtgctcgatttagacgtctcatcagggggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagagcccaccctctcctgcagggccagtcagagtgttagtaacacctagcctggtaccatcaagaacctggccaggcctcccagacctcctcattctatgatgcactcccaccgaggccagtcggtctcccagcctaggtacaggtcggctaggtcgggtcgtaggggacaggtacgtttccaacttccgtacccaacctacgtaccgaacggaccgtacggcccgttaggacccgtaacggtttaccgtaaggttaaacggtttagttttttcggaaccgttttaaggtttttttaaagtttacgttttacggttacgtaacgggttacttaaggtttaagtacgtttaacgtaccggtaggttcccggttacccttaccggtaacttacccgggtaaccccgtttaccgggggaccgttaaacgggggaccctaaccggtaaaccggttaccgggaaaaacctaaaacggttaaaacccgggtaaccgttaagggtcggttaccgtacggtaaccccgtaccttaacgtttccg

SEQ ID NO: 360228 - DNA, 527 bp, Homo sapiens
  misc_feature: GZ8MTXP02JFKKX.38.1.A01.1.454.CMB.2.raw
  modified_base (193)..(193): a, c, t, g, unknown or other
  misc_feature (193)..(193): n is a, c, g, or t
  modified_base (383)..(383): a, c, t, g, unknown or other
  misc_feature (383)..(383): n is a, c, g, or t
  modified_base (430)..(430): a, c, t, g, unknown or other
  misc_feature (430)..(430): n is a, c, g, or t
tcagtcgatcacgtcacgaccggtgctcgatttagacgtctcatcaggggggaactgctcagttaggacccagacggaaccatggaagccccagcgcagcttctcttcctcctgatactctagctcccagaaatcactggagaaatcgtgatgacgcagtctccagccaccctgtctgtgtctccgagggganagagccaccctctcctgcagggccagtcagagtgttagtaacaacctgcctggtaccatcagaaacctggcccaggcctcccagacctcctcatctatgatgcatcccaccgagggccacgttgggtctccccgagcctagggttccaggtcggctaggtgggtctggggacagcgttcactctaccacntcagcagcctgcagtctagaagtattttgacttagtttattattgtnagtactagtatgatcgagtcgcctcgtactctaccgttcggccgaggggacacggactagaacaataaacgaactggtacggctcgacacgacttcg

SEQ ID NO: 360229 - DNA, 556 bp, Homo sapiens
  misc_feature: GZ8MTXP02FLFTM.38.1.A01.1.454.CMB.2.raw
  modified_base (192)..(192): a, c, t, g, unknown or other
  misc_feature (192)..(192): n is a, c, g, or t
  modified_base (285)..(285): a, c, t, g, unknown or other
  misc_feature (285)..(285): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccagggganagagcccacccctctcctgccagggccagtcagagtgttagtaacaactagcctggtaccatcaagaacctggccaggctcccagacctcctnatctatgatgcatcccacgagggcccagtgggctcccagccctaggttccaggtcggactaggtgggtctaggggacaggtgttccacttccgtaccaacctatccgagccagccctgcagtctagaagtcttttgcgttaagtttattattgtacgtagtctagtatgtatcgtaggtcgcctaccgtatccgaccgttcggaccgacgggtacacggacgtacggaaacaaagtaaacgaagtcgtacggactcgactaccagtttacc

SEQ ID NO: 360230 - DNA, 550 bp, Homo sapiens
  misc_feature: GZ8MTXP02FLGEC.38.1.A01.1.454.CMB.2.raw
  modified_base (194)..(194): a, c, t, g, unknown or other
  misc_feature (194)..(194): n is a, c, g, or t
  modified_base (284)..(284): a, c, t, g, unknown or other
  misc_feature (284)..(284): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (394)..(394): a, c, t, g, unknown or other
  misc_feature (394)..(394): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtgttagtaacacctagcctggtaccatcagaaacctggccaggcctcccagacctccncatctatgatgcatccaccgagggcccatggtcgtcccagcctaggttcagtggcagtgggtcngggacngngttcactcncacatcancagcctgcagtctgaaagttntttagcttaagttttattattgacgtagtagtagttatgtacgtacgacggttcggaccctcgtactcccgtaccggtcggaccggaacggggacaccggtacgtaacggaaactaaaacgtaacggtacgtcggtcgacgtacgacctaccgtag

SEQ ID NO: 360231 - DNA, 590 bp, Homo sapiens
  misc_feature: GZ8MTXP02HSPRD.38.1.A01.1.454.CMB.2.raw
  modified_base (191)..(191): a, c, t, g, unknown or other
  misc_feature (191)..(191): n is a, c, g, or t
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (371)..(371): a, c, t, g, unknown or other
  misc_feature (371)..(371): n is a, c, g, or t
  modified_base (396)..(396): a, c, t, g, unknown or other
  misc_feature (396)..(396): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccacctgtctgtgtctcgagggganagagccacctntcctgcagggccagtcagagtgttagaacactagccttggaccatcagaactgccaggcnccagctcatcatgtatggtcactccacgacgggccacgtaggtcgtacccgaggcagggttcaaggagggaacggtccggggtacgtggggaacctaggtacggttacncgttcctacaacctaacttaaacgngttactgaccgagcgtagaagtagttttcgacgttagtttattaccgtgtacgagtactaaattagtagttactacgtcgggtaccctacgggtaccgttcggaccgtaggtacgggtaccggagggtacggaacgtacgaaacgacgtggacgtcgacgacactaactcgtacttctactactccttaccgac

SEQ ID NO: 360232 - DNA, 606 bp, Homo sapiens
  misc_feature: GZ8MTXP02ICLP3.38.1.A01.1.454.CMB.2.raw
  modified_base (285)..(285): a, c, t, g, unknown or other
  misc_feature (285)..(285): n is a, c, g, or t
  modified_base (325)..(325): a, c, t, g, unknown or other
  misc_feature (325)..(325): n is a, c, g, or t
  modified_base (379)..(379): a, c, t, g, unknown or other
  misc_feature (379)..(379): n is a, c, g, or t
  modified_base (405)..(405): a, c, t, g, unknown or other
  misc_feature (405)..(405): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctcctgcagggccagtcagagtgttagtaacactgcctaggtaccatcagaaacctggccaggctcccagacctcctnatctatgatcgcactcccacgaggggcccctacgtggtcnccccgagtcccgtagggtccagggtcggacgtagggttggggtcgtaggggacnggggttacttcaacctctacccgacnttccgagcacgccctagcgtaagtctagtaagttactttgacttagttttaatttatttggtactaggtctaggttaatgtaatcgtaaggtcggcccttacgtactcccgtaaccggttcgggaccgtacgggggaccacggtacgtaacggaacaaaacgtaaacgtaccgtagggtacgcgtacggaccctaactacg

SEQ ID NO: 360233 - DNA, 682 bp, Homo sapiens
  misc_feature: GZ8MTXP02H5OS8.38.1.A01.1.454.CMB.2.raw
  modified_base (190)..(190): a, c, t, g, unknown or other
  misc_feature (190)..(190): n is a, c, g, or t
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (392)..(392): a, c, t, g, unknown or other
  misc_feature (392)..(392): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccacctgtctgtgtctcgaggganagatccacctctcctgcagggccagtcagagtgttagaacactgcctgtacatcagaacngcagcnccagactcnatctangatcgacactcccaacgacggccacgttgggtcctacccaggaccccgtaaggttccaggtccgggacgtagggtcggggacgttggggactaggtcgtttacaaccttccgtaccaaccnctacgaacgcccaacgcccttagccgtagtacttaggtaaaaggttttcgttttacgagttttagttttaagttacgtttcggttacagttagtaagttacgtagttacgttacgtacggttcccggtacccttaccggtaccgttacccgtaacccggttccgggaaccgggtaaccggggtaaaccctaccgggtaacggtaaaccggtaaaaccgtaaaacgttaaaccgggtaaccggttcgggtaaccggtactaaccggtaaccctaaccgtttacgtttcccg

SEQ ID NO: 360234 - DNA, 556 bp, Homo sapiens
  misc_feature: GZ8MTXP02HMGGQ.38.1.A01.1.454.CMB.2.raw
  modified_base (297)..(297): a, c, t, g, unknown or other
  misc_feature (297)..(297): n is a, c, g, or t
  modified_base (554)..(554): a, c, t, g, unknown or other
  misc_feature (554)..(554): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctccagaaatcactggagaaatcgtgatgacgcagtctccagccaccctgtctgtgtctccgaggggagagagcccaccctctcctgcgagggccagtcagagttgttagtaacaacctagcctggtaccatcaagaacctggacccaggcctcccagacctcctcatctangatcgacactcccacgagggcctagtcggtcgtcccagccgtaggttcaggtggcctagggtcggtcgtggggaacaggtgttcacttcctacaccatcagcagcctgcagtctagtatatttgacttagtttattgttgctagtctagtatgattcgaggttcgacctcgtaacgtccaccggttcggacgaacgggcaaacgtacgacgggaaacaaacggtaaacgtacgtcggtacgacgtacgaccttaacncg

SEQ ID NO: 360235 - DNA, 621 bp, Homo sapiens
  misc_feature: GZ8MTXP02HX6QA.38.1.A01.1.454.CMB.2.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
  modified_base (435)..(435): a, c, t, g, unknown or other
  misc_feature (435)..(435): n is a, c, g, or t
  modified_base (621)..(621): a, c, t, g, unknown or other
  misc_feature (621)..(621): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagcccaccctgtctgtgtcctccgagggganagacgcccaccctctcctgcagggccagtcagngtgtagaacactagctgtacatcagaactgccagcctcccagactcctcatctatcgatgacactccccacgacgggcctagtgggtcctaccccagtcccgaaggtttcaaggttcggactagggtcggggtcgtacggggactagggtacgtttcaccgttcctacacccgtatcgagccacgcctgcagttcaggtaatttntttgactttagtttatttgttagtcgtagacgttagtacgtagtacgtacggtagtccggtaccctaccgtacgttacccgtacccggtaccggggaccgaaaccggggtaccgaacggtaacgttaaccggaaaacctaaaacgtaaacggtcgtacgggtacggacctacgaccctaaccgttn

SEQ ID NO: 360236 - DNA, 629 bp, Homo sapiens
  misc_feature: GZ8MTXP02IZLXL.38.1.A01.1.454.CMB.2.raw
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtntctccgagggganagacgccaccctctcctgcagggccagtcagagtgttaagaaccaactgcctgaccatcagaacnggccagcctccagacctccnatctatgatcgacactcccacgacgggcctacgtggtcctccccagtcccgtaggttcaggtcggcgtagggtcggggtctggggactagggtacgttccaccttcaccacctatacgaagccaacggccctgacctagttcctaggtaaagttacttttggactttaaggttttatttgttaggtccaagtcgtaggtaatggtaacttcgtaggtccggtaccctaccggtatacccgttaccggttaccggaccggaaacgggggtacccaaccggtaacgtacggtaaaacccgtaaaagtaaaacccggtaacgttggtacggaactccggacctaaaccgtcg

SEQ ID NO: 360237 - DNA, 533 bp, Homo sapiens
  misc_feature: GZ8MTXP02FKXRB.38.1.A01.1.454.CMB.2.raw
  modified_base (195)..(195): a, c, t, g, unknown or other
  misc_feature (195)..(195): n is a, c, g, or t
  modified_base (281)..(281): a, c, t, g, unknown or other
  misc_feature (281)..(281): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
  modified_base (406)..(406): a, c, t, g, unknown or other
  misc_feature (406)..(406): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcagggccagtcagagtgtagaacacctagcctggtacatcagaacctggccaggcctccagacctccncatctatgatgcatcccacgagggcctagtggtcgtcccagccgaggttcagtggcaggtggtcngggacngnttcatcncacatcagcacgcctgcagtcagtaatatttgacttagtttaatnttgtacagtctagttatagtatacgtagtcggcctacgactcgtaccgttcgggaccgtaggggaccacgtacgaacggaactaaaacgtaaaacgtacgtagtcgggtaacctacgaccacgtacg

SEQ ID NO: 360238 - DNA, 622 bp, Homo sapiens
  misc_feature: GZ8MTXP02ICVWH.38.1.A01.1.454.CMB.2.raw
  modified_base (190)..(190): a, c, t, g, unknown or other
  misc_feature (190)..(190): n is a, c, g, or t
  modified_base (278)..(278): a, c, t, g, unknown or other
  misc_feature (278)..(278): n is a, c, g, or t
  modified_base (384)..(384): a, c, t, g, unknown or other
  misc_feature (384)..(384): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccacctgtctgtgtctcgaggganagacgcccaccctctcctgcgagggccagtcagtagtgtagaacaactgcctgacatcaagaacctggaccaggccaccagacctccnatctatgatgccactcccgacgacgggcctacgtgggtcctccagccgtaggttcaggtccggacgtaggtcgggtcgtagggactagtcgttcacttcaccaccntacacgcacgcctgactagtctaggtaactttgttttcgactttaagttttattagtttcgtacgaggttataaaggtttatagtaacgttcggtacggttcccggttaccctaccgtacttaccccggtaacccggttccggggaaccggtaaacggggacctaacgggtacgtaaacgaaaaccgtaaaacgtaaaccgtaacgtcggtacgtacggactaccacctttacgtccg

SEQ ID NO: 360239 - DNA, 533 bp, Homo sapiens
  misc_feature: GZ8MTXP02GE2S8.38.1.A01.1.454.CMB.2.raw
  modified_base (195)..(195): a, c, t, g, unknown or other
  misc_feature (195)..(195): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgccaccctctcctgcagggccagtcagagtgttagtaacacctagcctggtaccatcagaaacctggccaggcctcccagacctcctcatctatgatgcatcccacgagggccacgtggtcgtccccagcctaggttcagtggcaggtggtctgggacngngttcactctcacatcagcagcctgcagtcagtaagtattttgacttagtttattagttgtacagctagtatgatcgagttcggacctcgactccgtaccgttcgggacctaacgggggaccacggtacgtacggaacaaagtaaaaccgacgtggtacggctagaccacctag

SEQ ID NO: 360240 - DNA, 563 bp, Homo sapiens
  misc_feature: GZ8MTXP02H3Q6R.38.1.A01.1.454.CMB.2.raw
  modified_base (234)..(234): a, c, t, g, unknown or other
  misc_feature (234)..(234): n is a, c, g, or t
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
  modified_base (315)..(315): a, c, t, g, unknown or other
  misc_feature (315)..(315): n is a, c, g, or t
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (409)..(409): a, c, t, g, unknown or other
  misc_feature (409)..(409): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctccagaaatcactggagaaatcgtgatgacgcagtctccagccaccctgtctgtgtctccgaggggagagacgcccaccctctcctgcgagggccagtcagagtgtanaacactagcctggaccatcagaacnggccagcctccagactcnatctangatgcactccacgaggccagtggcnccagccnggtcagtgctggtgggtcnggggacngtacttcncgtcncaccntcagcagcctgcgagttgtagaaagttgtttgtacttaagtttaagtttnttgtagtagtatagtatgtactcggtagtccgtacccgtacgtactacccggtaccggtaccgggaccggtaacggaccgaacggtaacgtaacggaaaacctaaaacggtaaaccgacggttacggacggtacctacgaacccgttacgtacg

SEQ ID NO: 360241 - DNA, 616 bp, Homo sapiens
  misc_feature: GZ8MTXP02G9F1J.38.1.A01.1.454.CMB.2.raw
  modified_base (164)..(164): a, c, t, g, unknown or other
  misc_feature (164)..(164): n is a, c, g, or t
  modified_base (195)..(195): a, c, t, g, unknown or other
  misc_feature (195)..(195): n is a, c, g, or t
  modified_base (278)..(278): a, c, t, g, unknown or other
  misc_feature (278)..(278): n is a, c, g, or t
  modified_base (430)..(430): a, c, t, g, unknown or other
  misc_feature (430)..(430): n is a, c, g, or t
  modified_base (496)..(496): a, c, t, g, unknown or other
  misc_feature (496)..(496): n is a, c, g, or t
  modified_base (503)..(503): a, c, t, g, unknown or other
  misc_feature (503)..(503): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtcnccagccaccctgtctgtgtctccgagggganagacgcccaccctctcctgcgagggccagtcagtagttagttaagtaaccaacgtagcctaggtaccatacaacggtaaaccnggacccaggcctcccagacctcctacactctatgatgactacaccacgacgggcctacgtcggtcctccccgagtccgtaggttcgacggtggccgtaggggtcggggtacgtaggggaacctgggtacttcccaaccgttccgacctaacncgtaacgcggcacggtcctggaccttaaggtctaaggtagtttatttgacgtttatttatcgttanacgagtntaagtgagtacgtcgtacggtcctcgtacgtacgtcccggtacggacgggacgtaacgggaccaacgtacggaaacaactaaaacgtaacgtgtcggactcgacgacctagtg

SEQ ID NO: 360242 - DNA, 716 bp, Homo sapiens
  misc_feature: GZ8MTXP02FRQM3.38.1.A01.1.454.CMB.2.raw
  modified_base (193)..(193): a, c, t, g, unknown or other
  misc_feature (193)..(193): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcagggccagtcagagtgttaagtaacaacctagcctaggtaccatcaagaacctggccaggcctacccagacctcctacatctatgatcgcactcccaccgagggccctacgttcgggtctccccgagcccgtaaggttccaggtcggcctagggtcggggtcgtaggggacctagggtacgtttccaacgtttcacccgaactatccgaagccaagtcccgtgaccgtaggttaccttaggtaaagtttacgtttttaggcctttaaaaggtttttacttttaaagtttcgtaacgttaaacggttacgttaaacggttaactagtaacgttacgttacgggttaccgtaccccgttacggtaccttacccgtaacccggttaccggggacccggtaaacgggggtaacctaaccgggtaaacggtaaacggaaaaccgtaaaacggttaaaaccgtaaccggttgggtacggtaccgtacgaaccgtaaccgttacgtttacg

SEQ ID NO: 360243 - DNA, 559 bp, Homo sapiens
  misc_feature: GZ8MTXP02FWN6X.38.1.A01.1.454.CMB.2.raw
  modified_base (164)..(164): a, c, t, g, unknown or other
  misc_feature (164)..(164): n is a, c, g, or t
  modified_base (195)..(195): a, c, t, g, unknown or other
  misc_feature (195)..(195): n is a, c, g, or t
  modified_base (293)..(293): a, c, t, g, unknown or other
  misc_feature (293)..(293): n is a, c, g, or t
  modified_base (387)..(387): a, c, t, g, unknown or other
  misc_feature (387)..(387): n is a, c, g, or t
  modified_base (405)..(405): a, c, t, g, unknown or other
  misc_feature (405)..(405): n is a, c, g, or t
  modified_base (437)..(437): a, c, t, g, unknown or other
  misc_feature (437)..(437): n is a, c, g, or t
  modified_base (471)..(471): a, c, t, g, unknown or other
  misc_feature (471)..(471): n is a, c, g, or t
  modified_base (492)..(492): a, c, t, g, unknown or other
  misc_feature (492)..(492): n is a, c, g, or t
  modified_base (530)..(530): a, c, t, g, unknown or other
  misc_feature (530)..(530): n is a, c, g, or t
  modified_base (547)..(547): a, c, t, g, unknown or other
  misc_feature (547)..(547): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtcnccagccaccctgtctgtgtctccgagggganagacgcccaccctctcctgccgagggccagtcaggtagttagttaagtaaccaacctagcctaggtaccatcagaacctggccagcctcccagctccnatcatgatcgacactcccgaccgaggtcccacgtcggtcgtaccccagtcctaaaggtccgaggtcggaccgtaggtcggggtcgtagggaacngggtacttcaccgttacnctaacagtcagcacgctagcagtcagtaagtntttagacgttatttattatgacaggtactagtangtatcgtaggtcgacctacgntcccgtacgtcggacgtacgggacacgtacgtacgaanaaacgtaacgagttcgngacctgacacta

SEQ ID NO: 360244 - DNA, 765 bp, Homo sapiens
  misc_feature: GZ8MTXP02JXGBY.38.1.A01.1.454.CMB.2.raw
  modified_base (194)..(194): a, c, t, g, unknown or other
  misc_feature (194)..(194): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactgggagaaatcgtgatgacgcagtctccagccaccctgtctgtgtctccgagggganagacgcccaccctctcctgcagggccagtcagtagtgtaagtaaccactgcctgtacatcaagaacctgccagctcccagacctcacatctatgatcgcactcccaacgacgggtctacgtgggtccgtcccgagcccgtaaggttccgaaggtccgggacgtagggttcggggtcgtggggaacctaggtcgttccaaccgttctaccgtaacctacgttccgaaacgccgtaacgtcccccgttaggacgtaacggttccgtaaacgggttaaagtttcgtttttaaggacctttttaaaggttttaagttttaaaccgtttggtttaacccgaagtacgtaaaggtttagtaacgttaacttccgggtaaaggtcccgggttacccctaccggttacggtttaacccctaccccggggtttaacgggacccccgggtaaggggggttaaaaccccaccggggttaaaccgttaaaccgggggaaaacctaaaaacggggttaaaaccgtcccgggttaaaggtttcggaacccgttacccggtaaacctaccccggtaatttccccgg

SEQ ID NO: 360245 - DNA, 574 bp, Homo sapiens
  misc_feature: GZ8MTXP02JVHUZ.38.1.A01.1.454.CMB.2.raw
  modified_base (282)..(282): a, c, t, g, unknown or other
  misc_feature (282)..(282): n is a, c, g, or t
  modified_base (418)..(418): a, c, t, g, unknown or other
  misc_feature (418)..(418): n is a, c, g, or t
  modified_base (570)..(570): a, c, t, g, unknown or other
  misc_feature (570)..(570): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgaggggagagagcccaccctctccgtgccagggccagtcagtagtgttagaacactagcctgtaccatcagaacctggccaggctccagacctcctnatctatgatgcatcccacgagggccagtggtctcccagccgtaggttccaggtcgacgtaggtggtacgtggggacaggtcgttccactacctccacctaatcgaacgcgacgccctgctaagtcgtagaagtttnttagtagttagtttattagtgtatagtactagtatgtactcgtcggtaccggtcctcgtacgtcccgtaccggttaccgggacggacgggtaccacggtacgacgtaaccgtaacgtaaacggaacgttcggacgtctaccgtactaccgtntccg

SEQ ID NO: 360246 - DNA, 546 bp, Homo sapiens
  misc_feature: GZ8MTXP02FHAA3.38.1.A01.1.454.CMB.2.raw
  modified_base (194)..(194): a, c, t, g, unknown or other
  misc_feature (194)..(194): n is a, c, g, or t
  modified_base (228)..(228): a, c, t, g, unknown or other
  misc_feature (228)..(228): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (394)..(394): a, c, t, g, unknown or other
  misc_feature (394)..(394): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccagggganagagccaccctctcctgcagggccagtcagagtnttaagaacaacctagcctggtaccatcagaaacctggccaggctcccagactcctcatctatgatgcactccaccgagggccacgtggtcgtccccagcccgaggttcagtcggcaggtggggtctgggacagngttcatcctanaccatcagcagcctgcagtcngaagtagttttgactagtttattagttgtacagtctagtatcgatctaggtcgccgtaccgtatccctaccgttccggaccggaaggggaccacggaacgtacggaactaaaacgtaaaacgtaacgtagtacgggcctacgaccaccgtag

SEQ ID NO: 360247 - DNA, 608 bp, Homo sapiens
  misc_feature: GZ8MTXP02HH26J.38.1.A01.1.454.CMB.2.raw
  modified_base (193)..(193): a, c, t, g, unknown or other
  misc_feature (193)..(193): n is a, c, g, or t
  modified_base (312)..(312): a, c, t, g, unknown or other
  misc_feature (312)..(312): n is a, c, g, or t
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
  modified_base (439)..(439): a, c, t, g, unknown or other
  misc_feature (439)..(439): n is a, c, g, or t
  modified_base (465)..(465): a, c, t, g, unknown or other
  misc_feature (465)..(465): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcagggccagtcagtagtgttaagaacaacctagcctaggtaccatcaagaacctggaccaggcctccagacctcctcatctatgatgctactcccaacgnggtcctagtcggtcgtacccagcccgtaggttcaggtccggctagggttcggtcgtagggactaggtcgttccaacgttctaccgacctanccaggccagccctnacgtagttctaggtaagttttntttcgatttagtttattagttcgtanagttagtaattagtacgtacgtacgtaccggtaccgtcctacgtacgtaccgtaccggtccgggacggtacggacctaaggtacgtaacgtaaactaaaacgtacgtaacggttcgacgtactacgacccgtacgttacgtcg

SEQ ID NO: 360248 - DNA, 809 bp, Homo sapiens
  misc_feature: GZ8MTXP02I5SMX.38.1.A01.1.454.CMB.2.raw
tcagtcgatcacgtcacgaccggtgctcgatttagacgtctcatcagggggaggaactgctcagttaggacccagacggaaccatggaagccccagcgcagcttctcttcctcctgatactctggcctcccagaaatcactggagaaatcgtgatgacgcagtctccagccaccctgtctgtgtctccgaggggagagacgcccaccctctcctgcgacgggccagtcagtagttagttaagtaaccaacctgcctaggtaccatcgaacgaaacctggaccaggcctcccagacctcctacactctatgatgaccactccccaaccgacgggcccctacggttcggtccgtacccccaaggtcccgtaggtttcgaaggttcgggaccgtaggggttcggggttacgtacgggggaactacggggtacgtttcccaaccgtttcccgtacccaaccctagttacccgaacggacctaccggtcccgttaggaccttaacggttaccgtttaagggttaaaacgttttcgtttttaccgggattttaaacggttttttaaatttacgttttacggttaccgttaggtaaccttaagggtttaacgttaggtaactttaccgggtaacgggtttcccggtacccctttaccgggtacctttacccccggttaaaccccgggtttcccgggggaaaccccgggaaacgggggtaaccctaaaccgggttaacgtaaccggtaaaaccgttaaaaacggtaaaaccggtaacgttcgggtaccggaccttaaccggaccctaaaccgtttcg

SEQ ID NO: 360249 - DNA, 606 bp, Homo sapiens
  misc_feature: GZ8MTXP02HHINF.38.1.A01.1.454.CMB.2.raw
  modified_base (194)..(194): a, c, t, g, unknown or other
  misc_feature (194)..(194): n is a, c, g, or t
  modified_base (389)..(389): a, c, t, g, unknown or other
  misc_feature (389)..(389): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgcccaccctctcctgcagggccagtcagagtgttaagaacactgcctggaccatcagaacctggccaggcctccagacctcctacatctaatgatgaccactcccaaccgaggcccagtcggtctccgagccgtaggttcaggtccggcgtagggtcggtcgtaggggacaggtcgttccactctacactncagactagcccgtgactagtctaggtaaattcgtttgacgttagttttatttagtgttaacaggtatagttacgtatacgttcgtacggtcgtacccgtctaacgtttcccggacccgtttacggggacccggtaaggggaacccaccggtaagtaacgggaactaaaacggttaaaccgaagtcggtacgacgttacgcctaaacgttacgttccg

SEQ ID NO: 360250 - DNA, 644 bp, Homo sapiens
  misc_feature: GZ8MTXP02F9ZRR.38.1.A01.1.454.CMB.2.raw
  modified_base (195)..(195): a, c, t, g, unknown or other
  misc_feature (195)..(195): n is a, c, g, or t
  modified_base (298)..(298): a, c, t, g, unknown or other
  misc_feature (298)..(298): n is a, c, g, or t
tcagtcgatcacgtcacgaccggtgctcgatttagacgtctcatcgagggggaggaactgctcagttaggacccagacggaaccatggaagccccagcgcagcttctcttcctcctgatactctggctcccagaaatcactggaagaaatcgtgatgacgcagtctccagccacctgtctgtgtctcgagggganagacgccaccctctcctgcgacgggccagtcagagtgttaagaacaactgcctggtacatcagaaacctggccaggcctacccgagtacctcctacatctatnatcgacactcccacgaggcctagtggtccacccagcctaggttcaggtcggactaggtcggggtctaggggactggtacttaccaacgttcctacccgaacctagttccgaacgaccgacggtcccgtagtaccgtaagttaccgtaggttaaaagttcgtttttagaacgtttaaggtttttaaattacgtttagttacgtagtactaaaggtactagtacgtacgtacggtccggtcctacgtactacccgtaccggttccggacggtacggggaaccaacggtaccgaacggaaactaaaacggtaaaaccgtggtacggtcggacctacgaccctacttacg

SEQ ID NO: 360251 - DNA, 553 bp, Homo sapiens
  misc_feature: GZ8MTXP02JNG1K.38.1.A01.1.454.CMB.2.raw
  modified_base (195)..(195): a, c, t, g, unknown or other
  misc_feature (195)..(195): n is a, c, g, or t
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
  modified_base (324)..(324): a, c, t, g, unknown or other
  misc_feature (324)..(324): n is a, c, g, or t
  modified_base (385)..(385): a, c, t, g, unknown or other
  misc_feature (385)..(385): n is a, c, g, or t
  modified_base (427)..(427): a, c, t, g, unknown or other
  misc_feature (427)..(427): n is a, c, g, or t
  modified_base (539)..(539): a, c, t, g, unknown or other
  misc_feature (539)..(539): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgccagggccagtcagagtgttaagaacaacctagccctggtaccatcagaaacctggccaggcctcccagacctccnatcctatnatgcatcccacgacggccagtggtcncccagcctagggtcacggtgctaggtggggtctggggactaggcgttcaccttcacgaccngtcagcacgctgctagtcgtagagtatttgactagtttattnttgctagctagtatagatcgtagtcggtcctacgtctccgtaccgttccgggacgtacgggggacctaccggacgtacgggaacaaacgttaaacgacgtaccggtggtacncggtaccacgtacg

SEQ ID NO: 360252 - DNA, 638 bp, Homo sapiens
  misc_feature: GZ8MTXP02G4FNQ.38.1.A01.1.454.CMB.2.raw
  modified_base (192)..(192): a, c, t, g, unknown or other
  misc_feature (192)..(192): n is a, c, g, or t
  modified_base (458)..(458): a, c, t, g, unknown or other
  misc_feature (458)..(458): n is a, c, g, or t
  modified_base (603)..(603): a, c, t, g, unknown or other
  misc_feature (603)..(603): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccacctgtctgtgtctccgagggganacgacgcccaccctctcctgcgagggccagtcagagtgtaacgtaacaacctgcctggacccatacaagaaccctggccaggcctcccagtacctccacattctatgatcgacactacccgaccgagggccctacggtcgggtcctaccccgaggtaccgtaggttccgaggttccggccgtagggttcggggtacgtaggggaacaggtcgttcacttccgaccacgtatcagctacgccctagcctagttcgaagtaacgtttntttacgatttagtttacttagtcgactagtattaggtatacgacgttacgtacggtccgtcccgttacgtacgttcccgtacccgggttcgggaacggaacgggtacctaacggtaacgtaacgtaaaacgtaacgttaaccggnggttcggaccgtacgtacgtaccacgttacgttcg

SEQ ID NO: 360253 - DNA, 807 bp, Homo sapiens
  misc_feature: GZ8MTXP02HF0ZW.38.1.A01.1.454.CMB.2.raw
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggagagacgccaccctctcctgcgagggccagtcagagtgttaagtaaccaacctagcctaggtaccactcaacgaaaccgtggacccaggccctacccgagtacccttccctctaacttcctaatcggaactcgacctaactacccccgaacccggtacggggacccctacggtttcggggttacccgtacccccgacggtccccgttaaggggtttacccgaaggtcccggggtacgtagggggtttcggggttaccggtaggggtaaacctagggttaccgggtttaccctaaacccgtttcctaaccccgtaaacctacgtacccgaaacgacctacggtcccctaggacgttacgttacgttaggtaaacgtttcgtttttaacggactttaaggtttatttacgttacgttacgagtactaggttacgttagtacgttacgtacgggttccgtaccgttacccgtacgtttacccgaccccgggtttaccggggacccggttaaagggggtacccctaaacggtaaccggtacgggtaaaaccaaaacggttaaaaccggtaaccggttaaggtacccggggtactacccgtactacccgttaacgtttcccg

SEQ ID NO: 360254 - DNA, 690 bp, Homo sapiens
  misc_feature: GZ8MTXP02IIHK2.38.1.A01.1.454.CMB.2.raw
tcagtcgatcacgtcacgaccggtgctcgatttagacgtctcatcaggggggaactgctcagttaggacccagacggaaccatggaagccccagcgcagcttctcttcctcctgatactctggctcccagaaatcactggaagaaatcgtgatgacgcagtctccagccaccctgtctgtgtctccgaggggagagacgcccaccctctcctgcagggccagtcagtagttgttaacgtaaccacctagcccgtggtaaccatcaacgaaaccgtggaccaggcctacccgagaccctcctacattctatgatcgaccactaccccgaccgagggtcccacgttcgggtcctacccgacgtaccgtaggtaccgtaggtcggtacgtaggggttcgggtacgtggggaactacggttacgtttccacccttacgtaccctacctacgtcaaccgctacgtcctgactacggttcgtaaggtaattcgttttacggtattagttttagtttaacgttggtactaacggtcgtaaagtttcgaagttagtaccgtaggtccggttcccgtacgttaacctccgttaccccggttacgggccgggtaaacgggaccgaacccgggtaaagtacgggtaaaactaaaggtaaaaccgaacgtcggttacggactaccggacctacggtctttcc

SEQ ID NO: 360255 - DNA, 649 bp, Homo sapiens
  misc_feature: GZ8MTXP02J0Q2Y.38.1.A01.1.454.CMB.2.raw
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccaggggaagagccacctctcctgcagggccagtcagagtgttataacaacttgcctggtaccatcagaactggccagcctacccagctctnatctangatgcactccacgagggccagtggtcgtccccagaccctaggttcaacgggtggaccagggttcggggtcctaggggactagggtacttccaaccgttcctacgaccctattaccgacgtaccacgtcccgtacgacccgtaaggttaccgtaaggtaaagtttacgtttttacggacctttaagtttttaactttacgtttaggtactagtaccgtaaggttatacggtaactcgtacgtaccgggaccttaccccgattacccgtacccgttacggacccggtaacggggcctaaacggtacccgaggtaaccgaaaacgttaaaaccgacgtttaggacggtacctacgaccctaccgttacg

SEQ ID NO: 360256 - DNA, 698 bp, Homo sapiens
  misc_feature: GZ8MTXP02GHYV5.38.1.A01.1.454.CMB.2.raw
  modified_base (194)..(194): a, c, t, g, unknown or other
  misc_feature (194)..(194): n is a, c, g, or t
  modified_base (255)..(255): a, c, t, g, unknown or other
  misc_feature (255)..(255): n is a, c, g, or t
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagcccaccctgtctgtgtctccgagggganagacgcccaccctctcctgcgagggccagtcagtagtgttaagaacactagcgtgtaccancaacgaaccnggaccagcctaccagacctccncatctatgatgacactacccacgcggcctacgtggtccgtcccacggtccgtaggtcgagtccggacgtagggtcgggtcgtacgggaacgtagtcgtccacttccgaccactagtacgacgacgtcgcccgtaggctacgtgttaagtaacgtttactttttggaacgtttaaagttttctttaacggtttaccggttaacgtaacggttacgtaaaggttaacgttacgttaaccggttccggttacggttcccgggtaccccttaccggttaaccgtacccgttaccgggtaccgggaccggggtaaacggtaacccgtaaacggtaacgtaaaccggtaaaactaaaaccggttaaacgtaacggttcggtaacgtaccgtaccgtaccgttaaccttacggtttcg

SEQ ID NO: 360257 - DNA, 567 bp, Homo sapiens
  misc_feature: GZ8MTXP02JEYSQ.38.1.A01.1.454.CMB.2.raw
  modified_base (193)..(193): a, c, t, g, unknown or other
  misc_feature (193)..(193): n is a, c, g, or t
  modified_base (207)..(207): a, c, t, g, unknown or other
  misc_feature (207)..(207): n is a, c, g, or t
  modified_base (292)..(292): a, c, t, g, unknown or other
  misc_feature (292)..(292): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (556)..(556): a, c, t, g, unknown or other
  misc_feature (556)..(556): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctntcctgcagggccagtcagagtgttaagtaacacctagcctggtaccatcagaaacctgaccaggctacccagactcctcatctangatgcatccaccagggccctagtcggtcgtcccagccgtaaggttcaggtcgggctaggtgggtctggggacagtacgttcacgttcctacgacctaagtcacgcacgtccctgacgtgtactagagttattttcgacttagtttattagttcgtatacgtnagttntacgntacgagtacgtccgtacgtagtacctaccgtacgggacccgtaggggaccacggtacgtacggaacaagtaaccgaagtcggacgtacgtancccagacttcg

SEQ ID NO: 360258 - DNA, 672 bp, Homo sapiens
  misc_feature: GZ8MTXP02I1HP3.38.1.A01.1.454.CMB.2.raw
  modified_base (195)..(195): a, c, t, g, unknown or other
  misc_feature (195)..(195): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagacgcccaccctctcctgcgacgggccagtcagtagtgttagtaacaaccgtgcctaggtaccatacaagaacctgccaggcctccgagacctcctcatctaagtgactcgactactacccgaccgaacggggccctaacggttcggtaccgaccccgagtccgtaggttacaggtcggaccgtaggtcggggtacgtacggggactaggtacgtttaccaccgttcctaccgaacctagtacccgaacgtcctaacggcccttggacccgttagtccgtaaggtaaacgtttgttttacacgtttaagttttaacttagttcggacttaagccgttaaagttagtagtaacgttcgtaacggtcggtccccttacgtacgtccccgtaacggttccgggaccggtaacgggtaaacctcgtaccggaacgtaacgtaaaagtaaccgtaggtcggtacggctacgtaccacctcg

SEQ ID NO: 360259 - DNA, 654 bp, Homo sapiens
  misc_feature: GZ8MTXP02I90DY.38.1.A01.1.454.CMB.2.raw
  modified_base (141)..(141): a, c, t, g, unknown or other
  misc_feature (141)..(141): n is a, c, g, or t
  modified_base (192)..(192): a, c, t, g, unknown or other
  misc_feature (192)..(192): n is a, c, g, or t
  modified_base (261)..(261): a, c, t, g, unknown or other
  misc_feature (261)..(261): n is a, c, g, or t
  modified_base (421)..(421): a, c, t, g, unknown or other
  misc_feature (421)..(421): n is a, c, g, or t
  modified_base (443)..(443): a, c, t, g, unknown or other
  misc_feature (443)..(443): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctccagaaatcactgganaatcgtgatgacgcagtctccagccaccctgtctgtcgtctccgagggganacgacgcccaccctctcctgcgacgggccagtcagagtagttaactaacactgctaggtaccatcgaanaacctcggaccaggtccctaccaagtacccttccacattcctaagtcgtatcgtacaccgtccaaccggaggtcccagttcgggtcctaccacgtccgtaggttaccaggttcggacgtagggtcggtacggtagggactaggtcgttcaccttccgtanaccgtatcaaggcacggtcccngtaccgagttcgtaaagtacgtttatttccggaattaggtttattagttagtcgtaaaagtattacgtaagtcgtacgtaacgggtctacccgtcgtacgttaaccgtccgttaccggggacgttaacgggggaaccttacgggacgtaaacggaccctaaaaggtaacccgagtaacggttcgaacgtaccgacctacgtttcttacgtc

SEQ ID NO: 360260 - DNA, 820 bp, Homo sapiens
  misc_feature: GZ8MTXP02H4MEJ.38.1.A01.1.454.CMB.2.raw
  modified_base (193)..(193): a, c, t, g, unknown or other
  misc_feature (193)..(193): n is a, c, g, or t
  modified_base (297)..(297): a, c, t, g, unknown or other
  misc_feature (297)..(297): n is a, c, g, or t
tcagtcgatcacgtcacgaccggtgctcgatttagacgtctcatcaggggggaactgctcagttaggaccctgacggaaccatggaagccccagcgcagcttctcttcctcctgatactctggctcccagaaatcactggagaaatcgtgatgacgcagtctccagcccacctgtctgtgtctccgagggganagacgcccaccctctcctgccgagggccagtcagtagtgttaagtaacaccgtagcctaggtaccatacaagtaaaccctggaccaggcctacccagacctccncactctaagtcgatgccactcccgaacccgagggccccagttacggggtccctaccccgaggtccccgtaggggtttacccagggttacgggcgtacgggttcgggggtaccttacgggggaccaagggttaccggtttaccaacccgtttacctacccaaccccgtaaagttcccgaaacgcccgtaaacgtccccgttggtaccgtacggttaccttaaggtaaaggtttaactttttaggtaccgtttaattttacgtttaagttttaccggtaactacgggttaactagggtttaattacggaaactttacccggggtaaggttcccgggtaccccctttacccggtaaacttaccccggtttaaccccggtttaccggggacccggggttaaacgggggaaccccgtaaaacggttaccccggttaaaaggggaaaaccctaaaacgggtttaaaaccggaaaccgtttggtaaccggggttacccttagggacccttaaaacctcggttttaacccg

SEQ ID NO: 360261 - DNA, 745 bp, Homo sapiens
  misc_feature: GZ8MTXP02HS3C7.38.1.A01.1.454.CMB.2.raw
  modified_base (552)..(552): a, c, t, g, unknown or other
  misc_feature (552)..(552): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccacctgtctgtgtctccgagggagagacgccaccctctccgtgccgacgggccagtcaagtagttagttaacgtaaccaaccgtagcctacggtaacccataccgaacgaaaccgtcggacccaaggcccctacccgaagtacccctcccttacacttaccgttaatggaacttcggacctaaccgtacccccgaaccggaccggggtacccctaggttcggggtcctaccccgaggtaccccgtaaggggttccaaggggtcggtaccgtagggttcggggttcgtaacggggaactacgggttacgttccaaaccgttcctaccgaccgtaatcgacgtacgaccggtcctaggactagttcgtaaggtaaatttgtttanacgtttaagttttatttgttcggtactaagtcttaaggactgtaccttcgtacgggttcctacccttacgtacgttaccccgtaccggttaccgggacccggaaaggggccctaaacggtacgttaaaacggaaccctaaaaggttaaacccgtaggttacggccgtacgttaccgacccttacggttaaccg

SEQ ID NO: 360262 - DNA, 819 bp, Homo sapiens
  misc_feature: GZ8MTXP02IVDGM.38.1.A01.1.454.CMB.2.raw
  modified_base (142)..(142): a, c, t, g, unknown or other
  misc_feature (142)..(142): n is a, c, g, or t
  modified_base (193)..(193): a, c, t, g, unknown or other
  misc_feature (193)..(193): n is a, c, g, or t
tcagtcgatcacgtcacgaccggtgctcgatttagacgtctcatcaggggggaactgctcagttaggacccagacggaaccatggaagccccagcgcagcttctcttcctcctgatactctggctcccagaaatcactgganaaatcgtgatgacgcagtctccagccaccctgtctgtgtctccgagggganagacgccctacctctcctgcgacgggccagtcagtagtacgttaacgtaacaacctagccgtacggtaccatacgacgaaaccgtggccacggcctcccagtaccctcctacatcctatgtacgcgtcacctacccgaccgacgggcctcggtcggtccgtacccaccggtaccgcggtttacaggtacggtccgtaggggtggggtaccgtgggaaaccgtaggtaccgttcccgtaactcccgttaaccaacccttagtaccggacaaccgtaccggtcccgttacggagtaaccggttacgtaaaggttaaacgttttgttttggtacctttaaaggtttttatttacggtttacgttacgaagggttcgtaaagtttacggtagtaaccgtttcgggacggttcccgttacccgttaacccgtttcccggttacccgttaaaccccggggttaccccgggaaacgggggtaaacccggtaccgtaaaacccccgggtttaagaaaaacccggggttaaaacgttaaaaaccggggttaaaaaccctttcggggaaaccggtttaacgggtaccccgtttaaaacccgggtttaccttccggtttaaacgtttttcccccggg

SEQ ID NO: 360263 - DNA, 907 bp, Homo sapiens
  misc_feature: GZ8MTXP02G0UL2.38.1.A01.1.454.CMB.2.raw
tcagtcgatcacgtcacgaccggtgctcgatttagacgtctcatcaggggggaactgctcagttaggacccagacggaaccatggaagccccagcgcagcttctcttcctcctgatactctggctcccagaaatcactggagaaatcgtgatgacgcagtctcagccaccctgtctgtgtctccgaggggagagacgcccacccgttcctccgtgccgacgggcctaagtaccaggtaggttacgtttaaacgtaaaccctaaccgtacggtccttacgggtaacccagttaccgaacgaaacccgtggacccgtaggcccctccgaacgaccccttcctacctaatccttaaagtgacgttcggcctaactccccgtaaacccggacggtccctaaccgttcgggtccgtacccccgagtccggtacggttaccgaggtccggaccggtagggttgggggttacccgttaaggggaccgtaagggttaccgtttaccgtacccttagttacccccgaacctaacgttacccgaaacgggccctaacgggttcccgtaacccggtaccggtaaaagtttcccgggtttaaaggtaaaaggggtttccttttttaaagggtacccggtttttaaaagttttttaattttacgggttttaacgggttaaccttaaagggtttacccgttaaaggggtttattaaccggtttaaacgggtccgtttaacggggtttccccggttaacccccgtttaccggggttaccccttaaccgggttaacccccgtttacgggggacccggttaaaacggggacccgttaaaccggggaacgtacggtaaaacgtaaaccgttaaaaccgggaacgtttacggacgtaccgttacggaaccctaatcggttttaccg

SEQ ID NO: 360264 - DNA, 603 bp, Homo sapiens
  misc_feature: GZ8MTXP02IOXUA.38.1.A01.1.454.CMB.2.raw
  modified_base (195)..(195): a, c, t, g, unknown or other
  misc_feature (195)..(195): n is a, c, g, or t
  modified_base (248)..(248): a, c, t, g, unknown or other
  misc_feature (248)..(248): n is a, c, g, or t
  modified_base (282)..(282): a, c, t, g, unknown or other
  misc_feature (282)..(282): n is a, c, g, or t
  modified_base (330)..(330): a, c, t, g, unknown or other
  misc_feature (330)..(330): n is a, c, g, or t
  modified_base (439)..(439): a, c, t, g, unknown or other
  misc_feature (439)..(439): n is a, c, g, or t
  modified_base (476)..(476): a, c, t, g, unknown or other
  misc_feature (476)..(476): n is a, c, g, or t
tcagtcgatcacgtcacgaccggtgctcgatttagacgtctcatcagggggaggaactgctcagttaggacccagacggaaccatggaagccccagcgcagcttctcttcctcctgatactctggctcccagaaatcactggagaaatcgtgatgacgcagtctccagccaccctgtctgtgtctccgagggganagagcccaccctctcctgcgagggccagtcagagttgtagtaacaacctgccngtacatcagaaacctggccagcctccagactccnatctatgatgctacacccaccgtagggcccctaacgtcgggtttaccnccccgaacgcccgtaaaggggtttccaaggtgggtaccgtagggtcggggttactggggtaccagggttacttacaccttctacccgacacgtcaagcaaccggtcacnctgtagtagtagttagttagtagttagtttattattntactagtagtagtagtagtagtacgtagtcgtccgtacgtactacgtaccgtccggacggacggacgaccgacgtacgaaacgtaaacgtaaacgtaacgtacgtacgtacgtacgtaccgactacg

SEQ ID NO: 360265 - DNA, 616 bp, Homo sapiens
  misc_feature: GZ8MTXP01CGWY5.25.25.C03.1.454.CMB.2.raw
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (316)..(316): a, c, t, g, unknown or other
  misc_feature (316)..(316): n is a, c, g, or t
  modified_base (391)..(391): a, c, t, g, unknown or other
  misc_feature (391)..(391): n is a, c, g, or t
  modified_base (491)..(491): a, c, t, g, unknown or other
  misc_feature (491)..(491): n is a, c, g, or t
tcagactgtacagtcacgaccggtgctcgatttagtagtgtagatttgggtttgggggaggcgtggtccagcctgggaggtccctgagactctcctgttcagcctctgggttcatgttcagttcctctactatacactgggtccgccacgccccccggcaaggggctggagtgggtggctcttatctcatatgatggaaatgttaaatactacgccgactccgtgaagggccgattcgccgtctccagagacaactcaaagaacaggtgttcngcaactgaacggctgagaaatgnggacncggctgtatattacngtgcgcgtatttctcctccctcgctcgccccatctacaactcgtctcatctgaaccgttcgtggggccaggggcncccgtgggtacccacgtcctcctcacgtccttacccgaccgaacgggcccctacgttccggtcccttcccccgtggccctcccgtcggcctccgagggcnccgaccgttcggcgggggccacgcggcccggcccgtgggcctcggtcccgttgggtaccaacgggtaaccttccgttacccgcttcggtaaccaggttccgtaggcgggcgggtcgttgggaacg

SEQ ID NO: 360266 - DNA, 644 bp, Homo sapiens
  misc_feature: GZ8MTXP01AO8MG.25.25.C03.1.454.CMB.2.raw
  modified_base (159)..(159): a, c, t, g, unknown or other
  misc_feature (159)..(159): n is a, c, g, or t
  modified_base (275)..(275): a, c, t, g, unknown or other
  misc_feature (275)..(275): n is a, c, g, or t
tcagactgtacagtcacgaccggtgctcgatttagtagtgtagatttgggtttgggggaggcgtggtccagcctgggaggtccctgagactctcctgttcagcctctgggttcatgttcagttcctctactatacactgggtccgccacgccccccggnaaggggctggagtgggtgctcttatctcatatgatggaaatgttaaatactacgccgactccgtgaagggccgattcgccgtctccagagacaactccaaagaacacggtgtttcngcaactgaacggcctagagaaatgtggacacggctgtatattactgtgcgcgtatttctctccctcgctcgccctactctacactctctcatctgaacgtcgtggggccagggcgcccctgggtcccaccgtcctccctcgacgccttacccaaccgaacgggtcccctaacgttcccggttccccttccccccgtcgggtccccgccccgttcgcccgttcccgacgggaccgcccgtacccgtcggtcgggggccaccgacggcccgggcccgtcgggccgtcggcccgttcgggtaccgaaacgggtaccttaaccgttcccgacttcgtaacctggtcctcgggacggccgggcgttcggaaccg

SEQ ID NO: 360267 - DNA, 688 bp, Homo sapiens
  misc_feature: GZ8MTXP02HHOWT.25.25.C03.1.454.CMB.2.raw
  modified_base (274)..(274): a, c, t, g, unknown or other
  misc_feature (274)..(274): n is a, c, g, or t
  modified_base (295)..(295): a, c, t, g, unknown or other
  misc_feature (295)..(295): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (549)..(549): a, c, t, g, unknown or other
  misc_feature (549)..(549): n is a, c, g, or t
tcagactgtacagtcacgaccggtgctcgatttagtagtgtagatttgggtttgggggaggcgtggtccagcctgggaggtccctgagactctcctgttcagcctctgggttcatgttcagttcctctactatacactgggtccgccacgccccccggcaaggggctggagtgggtgactcttatctcatatgatggaaatgttaaatactacgccgactccgtagaagggccgattcgccgtctccagagacaactccaagacacggtgttcngacaactcggaacgcctgaanaaatggtagacaggctgtatattactgtgcncgtatttccncctcctcgctcgaccctactctaaccgtactcgtcctctacttctaggaccgttcgtcggggggacccaagggggtaccgcccccgtttaggggtcccacccggttccctacccttccgaccgtccttacccgaacccgtaaaccgggcccctacgtcccgggttcccctttcccccgtcggcccgtccccgtcgtaccgtcccgagggaccncccgtacccgtcgggacggggacctacgcgggtcccggtccggtcgggccgtcggtaccgtcggtaacggtacggtaccttaccgttccgtaacttcgtaaccgtcggtacggtcggaccgggtcggacgtacggaacg

SEQ ID NO: 360268 - DNA, 554 bp, Homo sapiens
  misc_feature: GZ8MTXP01CSF7L.15.38.D05.1.454.CMB.2.raw
  modified_base (280)..(280): a, c, t, g, unknown or other
  misc_feature (280)..(280): n is a, c, g, or t
  modified_base (416)..(416): a, c, t, g, unknown or other
  misc_feature (416)..(416): n is a, c, g, or t
  modified_base (449)..(449): a, c, t, g, unknown or other
  misc_feature (449)..(449): n is a, c, g, or t
  modified_base (508)..(508): a, c, t, g, unknown or other
  misc_feature (508)..(508): n is a, c, g, or t
  modified_base (533)..(533): a, c, t, g, unknown or other
  misc_feature (533)..(533): n is a, c, g, or t
  modified_base (545)..(554): a, c, t, g, unknown or other
  misc_feature (545)..(554): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaaacgccaaagaactctctgtttctgcaaatgaacagtctgagagccgaggacacggcngtctattactgtgcgagaacccgtagagagtgggtaacaaaaggggagggacttactttgactacgtgggggccggggaacctggtcaccgtcctcctcagcctccaaaccaagggcccatccggtccttcccccnggccacccctcctaccaaagacgccaacctcgngggggccacgagccggcccctggggctgccctgggggtcaaacgggactaacttcccgntaaccggtagaacctgagcgggcgngcgagcgcagannnnnnnnnn

SEQ ID NO: 360269 - DNA, 513 bp, Homo sapiens
  misc_feature: GZ8MTXP01DPN8M.15.38.D05.1.454.CMB.2.raw
  modified_base (506)..(506): a, c, t, g, unknown or other
  misc_feature (506)..(506): n is a, c, g, or t
  modified_base (509)..(513): a, c, t, g, unknown or other
  misc_feature (509)..(513): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgagaacccgtagagatgggtacaaaaggggaggggacttactttgactaacgtgggggccgggaacctggtcaccgtcctcctcagcctccaaccaagggcccatcggtcttccccctggcaccctcctccaagagcactcgtgggggcacagcgccctggctgcctggggtcaaggctactcgctacgtgactgagcggctggcaaggcgcanagnnnnn

SEQ ID NO: 360270 - DNA, 541 bp, Homo sapiens
  misc_feature: GZ8MTXP01AXRCB.15.38.D05.1.454.CMB.2.raw
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (432)..(432): a, c, t, g, unknown or other
  misc_feature (432)..(432): n is a, c, g, or t
  modified_base (526)..(526): a, c, t, g, unknown or other
  misc_feature (526)..(526): n is a, c, g, or t
  modified_base (533)..(541): a, c, t, g, unknown or other
  misc_feature (533)..(541): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaagggctggagtgggtggccaacataaaccaagatggaagtgaagagtactatgtggactctgtgaagggccgcttcaccatttccagagacaacgccaagaactctctgtttctgcaaatgaacagtctgagagccgaggacacggcngtctattacngtgcgagaacccgtagagatgggtaacaaaaggggagggacttacgtttgactacgtgggggccgggaaccctggtcaccgtcctcctcagccctcaacccaacgggcccatcggtccttccccctggccaccctccctccaagngcacctcgtgggggcacgagccggcccgtgggctgacccgtggggtcaaggactaccgttccgcctacgtagactgagcgggctggcaagggcncttaagnnnnnnnnn

SEQ ID NO: 360271 - DNA, 654 bp, Homo sapiens
  misc_feature: GZ8MTXP01EQVK7.15.38.D05.1.454.CMB.2.raw
  modified_base (623)..(623): a, c, t, g, unknown or other
  misc_feature (623)..(623): n is a, c, g, or t
  modified_base (644)..(654): a, c, t, g, unknown or other
  misc_feature (644)..(654): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcacctatttccagagacaacgccaaagaactctctgtttctgacaaatgaacagtctgagagccgaggacacggctgtctattactgtgcgaacgaacccgtagaagagtaggtaacgaaaagggggagggtaacttacgtttagaacgttacggtcgggggacccgggaacccgtggtaccaccgttcccctcctcacgtccctcccgaaaacccgaaacgggcccctaacgtcccgggttcccctttcccccccgtcgggtacccctacccccttcccgtaacccaaagacgcccgtaacccgtcggtcgggggaccacgacgggcccggcccgtgggcctcggcccgttcgggggacgaaacgggtacccttacgttcccgactaaccggtaacgaccgtggacgggccgggcgngggaacaagggcgacagtagnnnnnnnnnnn

SEQ ID NO: 360272 - DNA, 624 bp, Homo sapiens
  misc_feature: GZ8MTXP01AT6IC.15.38.D05.1.454.CMB.2.raw
  modified_base (613)..(624): a, c, t, g, unknown or other
  misc_feature (613)..(624): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgagaacccgtagagagtagggtaacgaaaagggggagggggaactttaacgtttgaacgtacgtcggggggcccgggggtaaacccgtggtccaccgtcctccctcacgccctcccaaacccgaacgggccccagtcccgggtcccttccccccgtgggcccaccccgtccctacccaacgacgccaccctcgtcgggggaccacgacggcccggccccgtggggcctcggcccgtgggggtacaaacggggtaccttaaccgttcccggcctaaccgtagaccgtggacggccggggctgggaacaacgggcgcagtagnnnnnnnnnnnn

SEQ ID NO: 360273 - DNA, 616 bp, Homo sapiens
  misc_feature: GZ8MTXP01ET2FF.15.38.D05.1.454.CMB.2.raw
  modified_base (597)..(597): a, c, t, g, unknown or other
  misc_feature (597)..(597): n is a, c, g, or t
  modified_base (605)..(616): a, c, t, g, unknown or other
  misc_feature (605)..(616): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaaagaactctctgtttctgcaaatgaacagtctgagagccgaggacacggctgtctattactgtgcgagaacccgtagagagtgggtaacgaaaaggggaggggtacttacgtttgacgtacgtcgggggcccggggtaacccgtggtccaccgtccctccctcacgccctacccgaaacccgaaacgggcccccaagtcccgggttcccttccccccgtcgggacccacccctccctacccaaagacgccaccctcgtcgggggaccacgacggccggcccgtcgggcgtcgcccgtgggggtacaaacggtaccttaccttccggaccttacggtagaccgtggaggtcggggctgggccaaggggcncaagtagnnnnnnnnnnnn

SEQ ID NO: 360274 - DNA, 727 bp, Homo sapiens
  misc_feature: GZ8MTXP01DUHBF.15.38.D05.1.454.CMB.2.raw
  modified_base (706)..(706): a, c, t, g, unknown or other
  misc_feature (706)..(706): n is a, c, g, or t
  modified_base (714)..(715): a, c, t, g, unknown or other
  misc_feature (714)..(715): n is a, c, g, or t
  modified_base (717)..(717): a, c, t, g, unknown or other
  misc_feature (717)..(717): n is a, c, g, or t
  modified_base (719)..(719): a, c, t, g, unknown or other
  misc_feature (719)..(719): n is a, c, g, or t
  modified_base (721)..(721): a, c, t, g, unknown or other
  misc_feature (721)..(721): n is a, c, g, or t
  modified_base (727)..(727): a, c, t, g, unknown or other
  misc_feature (727)..(727): n is a, c, g, or t
tcagtctacgtagccacgaccggtgctcgatttagtatctgatagttgggtccctgagactcccctgtgtagcctctggattcaccttcagaggctttttggatgagttgggtccgccaggctccagggaagggctggagtgggtggccaacataaaccaagatggaagtgaagagtactatgtggactctgtgaagggccgcttcaccatttccagagacaacgccaaagaactctctgtttctgacaaatgaacagtctgagagccgaggacacggctgtactattactgtgcgaagaacccgtagagagtagggtaaacgaaaagggggagggtactttacgtttagacgttacggtcgggggacccgggtaaacccgtggtccacccggttccctccccgttcgaaccgcccctaccccgaaacccgaaaccggggtcccctaacgtccccgggttcccctttcccccccgtcgggacccctaacccccttcccctacccaaacggaccgcctaacccgtcggtacggggggaccaccgacgccccgggcccgttggggcccttcgggaccccgttggggggtaaccgtaaacggggtacccttaaccgttcccggaccgttaaacggtacggtaacgtcgggaacgggtccggggtcgtcggggaaccggaaacggggcccggaccttaaagttaacgggngcgcgcgnncncngngcgcgn

SEQ ID NO: 360275 - DNA, 616 bp, Homo sapiens
  misc_feature: GZ8MTXP01EG8AS.15.38.D05.1.454.CMB.2.raw
  modified_base (602)..(602): a, c, t, g, unknown or other
  misc_feature (602)..(602): n is a, c, g, or t
  modified_base (604)..(616): a, c, t, g, unknown or other
  misc_feature (604)..(616): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgaagaacccgtagagagtagggtaacgaaaaggggaggggtactttactttgacgtacgtcgggggaccgggaaccgtggtcaccgtcctccctcacgccctacccaaacccgaaacgggccccagtcccgggttcccttccccccgtcgggcccacccctccctacccaaacgacgccacccgtcggtcgggggaccaacgcggccggccccgtgggggccttcggcccgttgggggtacaaagggtaccttacgttcccgctacggtagaccgtggacggcgggctgggaacaaggggcacgttaagngnnnnnnnnnnnnn

SEQ ID NO: 360276 - DNA, 708 bp, Homo sapiens
  misc_feature: GZ8MTXP01EN3U5.15.38.D05.1.454.CMB.2.raw
  modified_base (694)..(694): a, c, t, g, unknown or other
  misc_feature (694)..(694): n is a, c, g, or t
  modified_base (696)..(697): a, c, t, g, unknown or other
  misc_feature (696)..(697): n is a, c, g, or t
  modified_base (699)..(708): a, c, t, g, unknown or other
  misc_feature (699)..(708): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaaacataaaccaagatggaagtgaagagtactatgtggactctgtgaagggccgcttcacctatttccagagacaacgcaagaactctctgtttctgcaaatgaacagtctgagagccgaggacacggctgtctattactgtgcgacgaaccgtagagagtagggtaaacgaaaagggggaggggtaactttacgtttaggaacgttacggtacggggggacccgggggtaacccgtggtcccgtaacccggttccctacccgttacgaccggcccctacccgaaaaccccgaacggggtccccctaacgttcccgggttccccctttcccccccgttacggggacccctaaccccccttccccgtacccgaaacggaccgacccgtacccgtccgggtacggggggaccaaccggaccggcccggggtccccgtggggcctacggtcccggtcgggggtaacgtaaacggtacccttaaccgttccgacgttaaccggtagtaccgtgggacggccgggtcgcgggaacgaacggcgcttaagngnngnnnnnnnnnn

SEQ ID NO: 360277 - DNA, 628 bp, Homo sapiens
  misc_feature: GZ8MTXP01CS4H4.15.38.D05.1.454.CMB.2.raw
  modified_base (294)..(294): a, c, t, g, unknown or other
  misc_feature (294)..(294): n is a, c, g, or t
  modified_base (616)..(628): a, c, t, g, unknown or other
  misc_feature (616)..(628): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaaacataaaccaagatggaagtgaagagtactatgtggactctgtgaagggccgcttcaccatttccagagacaacgccaaagaactctctgtttctgacaaatgaacagtctggagaggccgaggacacggctgtactattacngtgacgacgaacccgtagagagtagggtaaacgaaaaggggagggtacttacgttgaacgttacggtcgggggacccgggtaaccctggtaccacccgttcccgtccctacgacgtccctacccaaacccgaacggggccccagttcccgggtcccttcccccgtaggcccctacccctcctacccgaagacgtccaccgtcggtacgggggcacgacggcccgcccggtgggacctcgccgtgggggtaccaaagggtcctaccgttccgacgtacgtacgacctggaccggcgggtctcgggcgaaagggcacagtacgnnnnnnnnnnnnn

SEQ ID NO: 360278 - DNA, 519 bp, Homo sapiens
  misc_feature: GZ8MTXP02JKWWM.15.38.D05.1.454.CMB.2.raw
  modified_base (503)..(503): a, c, t, g, unknown or other
  misc_feature (503)..(503): n is a, c, g, or t
  modified_base (510)..(519): a, c, t, g, unknown or other
  misc_feature (510)..(519): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgagaacccgtagagatgggtacaaaagggaggggacttacgtttgactacgtggggccggggaacctggtcacgtctcctcagcctccaccaagggcccatcggtcttccccctggccaccctcctcccaagcgcacctctgggggcacgagcgcctgggctgccctggtcaaggactacttccgctacgagactgagcggctggcaaggngcatagnnnnnnnnnn

SEQ ID NO: 360279 - DNA, 516 bp, Homo sapiens
  misc_feature: GZ8MTXP02GQ6YZ.15.38.D05.1.454.CMB.2.raw
  modified_base (508)..(516): a, c, t, g, unknown or other
  misc_feature (508)..(516): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgagaaccccgtagagatgggtacaaaagggaggggacttacttgactactggggccgggaaccctggtcaccgtcctcctcagcctcaccaagggcccatcggtcttccccctgcaccctcctccaagagcacctctgggggcacagcggccctgggctgcctggtcaaggactacttccgctacgtagactgagcgggctggcaaggcgcatagnnnnnnnnn

SEQ ID NO: 360280 - DNA, 547 bp, Homo sapiens
  misc_feature: GZ8MTXP02JJDJB.15.38.D05.1.454.CMB.2.raw
  modified_base (538)..(547): a, c, t, g, unknown or other
  misc_feature (538)..(547): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgagaaccccgtagagatgggtacaaaagggaggggacttacttgactacgtggggccgggaacctggtcaccgtcctcctcagcctcaccaacgggcccatcggtccttccccctggcacccctcctcccaagacgccaccctcgtcgggggccacgacgccggccccgtggggccttgccccttgggtccaagggacctacttccgcctacgtacgactgaggcgggctggcaaggcgacatagnnnnnnnnnn

SEQ ID NO: 360281 - DNA, 539 bp, Homo sapiens
  misc_feature: GZ8MTXP02HZTS0.15.38.D05.1.454.CMB.2.raw
  modified_base (527)..(527): a, c, t, g, unknown or other
  misc_feature (527)..(527): n is a, c, g, or t
  modified_base (530)..(539): a, c, t, g, unknown or other
  misc_feature (530)..(539): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgagaacccgtagagagtgggtaacaaaaggggaggggacttactttgactacgtggggccggggaaccctggtcaccgtcctcctcagcctccaccaacgggcccatcggtccttccccctggccaccctccctccaagacgcacctcgtgggggcacgagccggccctgggctcgcctggtacaaggacctacgttccgctaccgtagactgagcgggctggcaaggcgactanagnnnnnnnnnn

SEQ ID NO: 360282 - DNA, 594 bp, Homo sapiens
  misc_feature: GZ8MTXP02G8BAT.15.38.D05.1.454.CMB.2.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
tcagtctacgtagccacgaccggtgctcgatttagtatctgatagttgggtttgggggtctcagagaggagccttagccctggactccaaggcctttccacttggtgatcagcactgagcacagaggactcaccatggaattggggctgagctgggttttccttgttgctattttagaaggtgtccagtgtgaggtncagctggtggagtcgtggggganacttggtccaggcccggggggtccctgagactcccctgtgtagcctctggattcaccttcagaggtcttttggatgaggttggtccgccaggctcgaggggaggggctggagtgggtggccaacataaaccagatggaaagtgaagagtactatgtggacttcgtgtggaaacggggccgtcttaccacctatttcccaagacgaaccaaacgaccaaagaacctctccttagtttctagacaaaatgaaactagtctagagaggccgaggacacggctgtctatactgtcgcgacgaccgtagagagtacgggtaacgaaaaggggcggggtaacttacgtttcggacgtacggtcgggggaccggtaacccg

SEQ ID NO: 360283 - DNA, 565 bp, Homo sapiens
  misc_feature: GZ8MTXP02IYUOP.15.38.D05.1.454.CMB.2.raw
  modified_base (553)..(553): a, c, t, g, unknown or other
  misc_feature (553)..(553): n is a, c, g, or t
  modified_base (555)..(565): a, c, t, g, unknown or other
  misc_feature (555)..(565): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgagaacccgtagagatgggtaacaaaaggggagggacttactttgactacgtggggccgggaaccctggtcaccgtcctcctcacgcctccaccaacgggcccatcggtccttccccctggccaccctcctcccaaagacgccaccctcgtcgggggcacgacgccggcccgtgggctcgccctggtcgaaagggacctacgttcccgaccgtacgtacgacctggacggcgggcgtggaccgaaagggccgcaagtacgncnnnnnnnnnnn

SEQ ID NO: 360284 - DNA, 533 bp, Homo sapiens
  misc_feature: GZ8MTXP02GMKRW.15.38.D05.1.454.CMB.2.raw
  modified_base (497)..(497): a, c, t, g, unknown or other
  misc_feature (497)..(497): n is a, c, g, or t
  modified_base (520)..(520): a, c, t, g, unknown or other
  misc_feature (520)..(520): n is a, c, g, or t
  modified_base (522)..(533): a, c, t, g, unknown or other
  misc_feature (522)..(533): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaaagaactctctgtttctgcaaatgaacagtctgagagccgaggacacggctgtctattactgtgcgagaaccccgtagagatgggtacaaaagggaggggacttactttgactacgtggggccggggaacctggtcaccgtcctcctcagcctccaccaagggcccatcggtcttccccctggccaccctccctccaacgagcacctctgggggcacgagccggccctgggctgcctggtcaaggctacttccgctacgtacgactagngcgggctggcgaaggcgacagancnnnnnnnnnnnn

SEQ ID NO: 360285 - DNA, 528 bp, Homo sapiens
  misc_feature: GZ8MTXP02I49KT.15.38.D05.1.454.CMB.2.raw
  modified_base (511)..(511): a, c, t, g, unknown or other
  misc_feature (511)..(511): n is a, c, g, or t
  modified_base (518)..(528): a, c, t, g, unknown or other
  misc_feature (518)..(528): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgagaaccccgtagagatgggtaacaaaaggggaggggacttactttgactacgtggggcccgggaaacctggtcaccgtcctcctcagcctcaccaagggcccatcggtccttcccccgtgccacccctcctccaagacgcacctctgggggcacagcggccctgggctgcctggtcaagctacttccgctacgtagactgacgcgggctggcaaggcncgatagnnnnnnnnnnn

SEQ ID NO: 360286 - DNA, 581 bp, Homo sapiens
  misc_feature: GZ8MTXP02JUHWP.15.38.D05.1.454.CMB.2.raw
  modified_base (535)..(535): a, c, t, g, unknown or other
  misc_feature (535)..(535): n is a, c, g, or t
  modified_base (569)..(581): a, c, t, g, unknown or other
  misc_feature (569)..(581): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgagaaccccgtagagagtgggtacaaaaggggaggggactttacgtttgactacgtggggccggggaacctggtccacgtccctcctcacgccctccaccaacgggccccaatccggtccttcccccgtggcccacccctccctacccaagacgccaccctcgtgggggccacgcggccggcccgtgggcctcggcccgttgggtcaacgggaccttaccgttccgcctacgtagacgtcggngcggggctcgggacgaacgggcgaccgataacgnnnnnnnnnnnnn

SEQ ID NO: 360287 - DNA, 595 bp, Homo sapiens
  misc_feature: GZ8MTXP02H5TX3.15.38.D05.1.454.CMB.2.raw
  modified_base (425)..(425): a, c, t, g, unknown or other
  misc_feature (425)..(425): n is a, c, g, or t
  modified_base (583)..(583): a, c, t, g, unknown or other
  misc_feature (583)..(583): n is a, c, g, or t
  modified_base (585)..(595): a, c, t, g, unknown or other
  misc_feature (585)..(595): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgcaagaactctctgtttctgcaaatgaacagtctgagagccgaggacacggctgtctattactgtgcgagaacccgtagagagtagggtaacgaaaaggggagggtactttacgttgaactacggtcggggacccgggaacctggtccaccgtcctcctcacgccctcaccgaacgggcccagtccggtcccttcccccgnggcccacccctccctaccaacgcgccaccgtcgtcgggggacaccgacggcccggcccgtgggcctcgccgtacggtcgaaacgggtaccttaccgttccgaccgtacgtacgtacgtaggacggcgggtcgtcggacgagggaccgcgaagtacgcncnnnnnnnnnnn

SEQ ID NO: 360288 - DNA, 621 bp, Homo sapiens
  misc_feature: GZ8MTXP02HI2AD.15.38.D05.1.454.CMB.2.raw
  modified_base (612)..(621): a, c, t, g, unknown or other
  misc_feature (612)..(621): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgagaaccccgtagagagtgggtaacgaaaaggggaggggactttacgtttgactacgtggggcccggggaaacctggtccaccgtcctcctcacgcctccaaccaacgggcccacgtccggtcccttcccccgtcggcccaccccgtccctcccaacgacgccacccgtcgtcgggggccaccgacggcccggcccgtcgggccgtcggcccgttgggtaccgtaaacgggtaccgttacccgtttcccgaccgttaaccggtaacggtaccgtcggaacgggccggggcgtcgggacgaacgggccgacgatacgcgcnnnnnnnnnn

SEQ ID NO: 360289 - DNA, 629 bp, Homo sapiens
  misc_feature: GZ8MTXP02FPHI1.15.38.D05.1.454.CMB.2.raw
  modified_base (617)..(629): a, c, t, g, unknown or other
  misc_feature (617)..(629): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaaggccgcttcaccatttccagagacaacgccaagaactctctgtttctgcaaatgaacagtctgagagccgaggacacggctgtctattactgtgcgagaaccccgtagagagtagggtaacgaaaaggggaggggactttacgtttgactacgtcggggcccggggaaacccgtggtaccaccgtccctccctcgaacgccctacccgacccgaaacggggcccccaagtcccgggttccctttcccccccgtggcccaccccctccctacccaaagacgccaaccctcggtcgggggaccacgacgccggcccgtcggggctcggcccgttaggtaccgaaacgggtaccttaccgttccgccgtaacggttacgaaccgtggacgccggggcgtacgggacgaaacggcgtacaatagnnnnnnnnnnnnn

SEQ ID NO: 360290 - DNA, 579 bp, Homo sapiens
  misc_feature: GZ8MTXP02F6PFD.15.38.D05.1.454.CMB.2.raw
  modified_base (393)..(393): a, c, t, g, unknown or other
  misc_feature (393)..(393): n is a, c, g, or t
  modified_base (453)..(453): a, c, t, g, unknown or other
  misc_feature (453)..(453): n is a, c, g, or t
  modified_base (564)..(564): a, c, t, g, unknown or other
  misc_feature (564)..(564): n is a, c, g, or t
  modified_base (568)..(579): a, c, t, g, unknown or other
  misc_feature (568)..(579): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaagggctggagtgggtggccaacataaaccaagatggaagtgaagagtactatgtggactctgtgaagggccgcttcaccatttccagagacaacgccaaagaactctctgtttctgacaaatgaacagtctgagagccgaggacgacggctgtactattacgtgtcgacgacgaacccgtagagagtagggaacgaaaaggggagggtactttacgttgaacgtacggtgggggacccgggaaccgtggtccgaccgtcctccncacgccctccaaccgaggcccagtccgtcctcccccgtcgccacccctcctaccagaccnctaccgtcggtcggggacaccgacggcccggccgtcggctcggccgtcggtacgaacgtcttaccgtccgaccgtaggacgacgtggaggcggtcgaggacgagcgactanagcnnnnnnnnnnnn

SEQ ID NO: 360291 - DNA, 628 bp, Homo sapiens
  misc_feature: GZ8MTXP02G7BD2.15.38.D05.1.454.CMB.2.raw
  modified_base (616)..(616): a, c, t, g, unknown or other
  misc_feature (616)..(616): n is a, c, g, or t
  modified_base (618)..(628): a, c, t, g, unknown or other
  misc_feature (618)..(628): n is a, c, g, or t
tcagtctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaagaactctctgtttctgacaaatgaacagtctgagagccgaggacacggctgtctattactgtgcgacgaacccgtagagagtagggtaacgaaaaggggaggggtacttacgttagacgtacggtgggggacccgggaacctggtacaccgtccctccctcacgccctaccgaccgaacgggcccacgttccggttcccttcccccgtcggacccaccccttccctacccgaaagccgcccgtacccgtcggtcgggggacccaacgcggcccggtcccggtgggccgttacggcccgttcgggtacgaaacggtaccttacccgttacccgaccttacgaacgtacgtgggaccgggtcgggcgtcggacgaacggcgacatacgncnnnnnnnnnnn

SEQ ID NO: 360292 - DNA, 425 bp, Homo sapiens
  misc_feature: GZ8MTXP01B7LUV.44.72.G06.1.454.CMB.2.raw
  modified_base (418)..(425): a, c, t, g, unknown or other
  misc_feature (418)..(425): n is a, c, g, or t
tcagacagtatatacacgaccggtgctcgatttagctacgactgcaagggaaagggctggagtgggtggccatcatgaagaaagatggaactgagacacactatgtggactctgtgaagggccgattcaccatctccagagacaacgccaagaactcactgtatctgcaaatgaacagtctgagagtcgaggacacggctgtgtattattgtgcgggaggcgctggggtgctcattgactacgtggggtcagggaaccctggtccaccgtctcctcacgcctccaccaagggccccatccggtccttccccctggccgccctgcctccaggacgcacctccgagacgcacagccgccctgggctgcctgtcaaggctacttctatatactgtctgagcgggctggcaaggcgcatagnnnnnnnn

SEQ ID NO: 360293 - DNA, 466 bp, Homo sapiens
  misc_feature: GZ8MTXP01EN56K.44.72.G06.1.454.CMB.2.raw
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (319)..(319): a, c, t, g, unknown or other
  misc_feature (319)..(319): n is a, c, g, or t
  modified_base (442)..(443): a, c, t, g, unknown or other
  misc_feature (442)..(443): n is a, c, g, or t
  modified_base (445)..(466): a, c, t, g, unknown or other
  misc_feature (445)..(466): n is a, c, g, or t
tcagacagtatatacacgaccggtgctcgatttagctacgactgcaagggaaagggctggagtgggtggcctatcatgaagaaagagtggaactgagaccacactatgtggactctgtgaagggccgaacttcaccatcctccagagacaacgccaagaactcactgtatctgcaaatgaacagtctgagagtcgaggaccacggctgtgtattagttgtgcggagcgngtgggtggctnattggaccgtactggggtcagggaaccctggcaccgtctcctcagcctccaccaagggccccagtcggtcttacccccnggccgcccctggcctccgacggacgccaccgtccggagacgcacgagcggcccgtgggctgcctgggcaaggtactacgttcctatatactgtctgaggcgggcgtggcgaaggcgcatacgnngnnnnnnnnnnnnnnnnnnnnnn

SEQ ID NO: 360294 - DNA, 443 bp, Homo sapiens
  misc_feature: GZ8MTXP01C9C4Q.44.72.G06.1.454.CMB.2.raw
  modified_base (437)..(443): a, c, t, g, unknown or other
  misc_feature (437)..(443): n is a, c, g, or t
tcagacagtatatacacgaccggtgctcgatttagctacgactgcaagggaaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactactactacggtatggacgtctggggccaagggaccacggtcaccgtctcctcagcttccaccaagggcccatcggtcttccccctggcgccctgctcaggacgcactctgggggcaacagcggccctgggctgcctggtcaaggctacttcctatatactgtctgagcgggctggcaaggcgcatagnnnnnnn

SEQ ID NO: 360295 - DNA, 456 bp, Homo sapiens
  misc_feature: GZ8MTXP01CUBKT.44.72.G06.1.454.CMB.2.raw
  modified_base (273)..(273): a, c, t, g, unknown or other
  misc_feature (273)..(273): n is a, c, g, or t
  modified_base (451)..(456): a, c, t, g, unknown or other
  misc_feature (451)..(456): n is a, c, g, or t
tcagacagtatatacacgaccggtgctcgatttagctacgactgcaagggaaaggggctggtgtgggtctcacgtattaatagtgatgggagtagcacaagctacgcggactccgtgaagggccgattcaccatctccagagacaacgccaagaacacgctgtatctgcaaaatgaacagtctgagagccgaggacacggctgtgtattactgtgcaagagccggtgcgggagttcgggggagttgcatactactactacggtatggacgtcngggccaagggaccacggtcaccgtctcctcagcttccaccaaggccccatcggtccttcccccgtggccgccctgctccaggacgcaccgtcgtcgggggcaacacgccggcccgtggggctcgcctggtcaaggactactcctatatactgtctgagcgggctggcaagcgcatagnnnnnn

SEQ ID NO: 360296 - DNA, 417 bp, Homo sapiens
  misc_feature: GZ8MTXP01EAX4O.44.72.G06.1.454.CMB.2.raw
  modified_base (311)..(311): a, c, t, g, unknown or other
  misc_feature (311)..(311): n is a, c, g, or t
  modified_base (342)..(342): a, c, t, g, unknown or other
  misc_feature (342)..(342): n is a, c, g, or t
  modified_base (412)..(417): a, c, t, g, unknown or other
  misc_feature (412)..(417): n is a, c, g, or t
tcagacagtatatacacgaccggtgctcgatttagctacgactgcaagggaaaggggctggagtgggtggccatcatgaagaaagatggaactgagacacactatgtggactctgtgaagggccgattcaccatctccagagacaacgccaagaactcactgtatctgcaaatgaacagtctgagagtcgaggacacggctgtgtattattgtgcgggaggcgctgggtggctcattgactactggggtcagggaaccctggcaccgtctcctcagcctccaccaagggcccatcggtcttccccctggcnccctgcctccaggagcacctcgagacgcacngcggccctgggctgctggtcaaggactacttcctatatactgtctgagcgggctgggcaaggcgcatagnnnnnn

SEQ ID NO: 360297 - DNA, 595 bp, Homo sapiens
  misc_feature: GZ8MTXP01EDV5Z.44.72.G06.1.454.CMB.2.raw
  modified_base (298)..(298): a, c, t, g, unknown or other
  misc_feature (298)..(298): n is a, c, g, or t
  modified_base (342)..(342): a, c, t, g, unknown or other
  misc_feature (342)..(342): n is a, c, g, or t
  modified_base (499)..(499): a, c, t, g, unknown or other
  misc_feature (499)..(499): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggaggcttggtccagccgtgggggtccctgagactctcctgtgcagcctctggattcacctttagtagtatggatgaactgggtccncaggctcgaggggaggctggagtgggtgccatcatgaagaaagntggaacctgagacacactaatgtggactcgtgtaggaacgggccgattccacctatcctaccgaagaacgaacaaaccgccaaaagaacctcaactgtaatctagggaactaaaagtcgaaactggtctggaagtaggtccgaagggaccacgggtnttggttgttatttagttgggtacgggcgggggaggttccggttcgggttgggggtcgtccttacgtagtttacgggtaaccgttcggggtcggggg

SEQ ID NO: 360298 - DNA, 546 bp, Homo sapiens
  misc_feature: GZ8MTXP01C30BH.44.72.G06.1.454.CMB.2.raw
  modified_base (459)..(459): a, c, t, g, unknown or other
  misc_feature (459)..(459): n is a, c, g, or t
  modified_base (478)..(478): a, c, t, g, unknown or other
  misc_feature (478)..(478): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagcgtggtttcctgttgctatttagaaggtgtccagtgtgaggtgcaactggtggagtcgtggggggaggcttggtccaggccgtggggggtccctgagactctcctgtgcagcctctggattcacctttagtagtattggatgaactgggtccgccaggctccgaggggaaggggctgggaggtgggtgggccatcatgaaagaaagatggaacctggagacacactaaatgtggactctggtgaagggcgatcaccatcctcagagaacaacgaccaaagaacctcactgtatctaggacaaatgaacagtcngagagtcgaggacacggtntgtgttattagttggtcggcgggaggcgttcggtggggtcgtctgtagttcgtaacgttcgggtgggg

SEQ ID NO: 360299 - DNA, 580 bp, Homo sapiens
  misc_feature: GZ8MTXP01DD188.44.72.G06.1.454.CMB.2.raw
  modified_base (298)..(298): a, c, t, g, unknown or other
  misc_feature (298)..(298): n is a, c, g, or t
  modified_base (379)..(379): a, c, t, g, unknown or other
  misc_feature (379)..(379): n is a, c, g, or t
  modified_base (493)..(493): a, c, t, g, unknown or other
  misc_feature (493)..(493): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggaggcttggtccagccgtgggggtccctgagactctcctgtgcagcctctggattcactttagtagtattggatgaactgggtccncgaggctccgaggggaagggctggaggtgggtgccatcatagaaagaaagatggaaacctgagacacactaatgtggactntggtggaacgggccgattccacctatcctaccagaagaaccaaacgccctaaagaacctcaactgtatctaggacaaaatcgaaacagtcagagaacgtcgaaggacacgggtnttggtattatttagttcggtgggacggggaggcgttcggttgggggtcgtcttacgtagtttacggaaccgtttaacgggtcggggg

SEQ ID NO: 360300 - DNA, 605 bp, Homo sapiens
  misc_feature: GZ8MTXP01D67HN.44.72.G06.1.454.CMB.2.raw
  modified_base (424)..(424): a, c, t, g, unknown or other
  misc_feature (424)..(424): n is a, c, g, or t
  modified_base (505)..(505): a, c, t, g, unknown or other
  misc_feature (505)..(505): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagcttgggttttccttgttgcttattttagaaggtgtccagtgtgaggtgcaacgtggtggaggtcgtgggggaggcttggtccaggccgtgggggtccctgagctctcctgtgcagcctcgtggtacttctactttagtagtatggatgaacgtggtccgcgaggctccgaggggacgggcgtgggaggtgggtggccagtcagtagaaagaaagagtaggaacctgaagacactactaagtgtggactcgtggtacggaacgggccgtattccaactntccacagacgaacaaacgccaaagacctcactgatccaggaacaaagtcgaactgtcgagagacgtcgaagggactcgggnttaaggttagttaagtttaggttgggcgggtacgggggacgttcgggttcgggttggggtcgtcttcgtagttcggtaaccggttcgggttaaccggggg

SEQ ID NO: 360301 - DNA, 569 bp, Homo sapiens
  misc_feature: GZ8MTXP01AUQT5.44.72.G06.1.454.CMB.2.raw
  modified_base (325)..(325): a, c, t, g, unknown or other
  misc_feature (325)..(325): n is a, c, g, or t
  modified_base (481)..(481): a, c, t, g, unknown or other
  misc_feature (481)..(481): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
  modified_base (516)..(516): a, c, t, g, unknown or other
  misc_feature (516)..(516): n is a, c, g, or t
  modified_base (524)..(524): a, c, t, g, unknown or other
  misc_feature (524)..(524): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttcctgttgctatttagaggtgtccagtgtgaggtgcaactggtggagtcgtgggggagcttggtccagccgtgggggtccctgagactctcctgtgcagcctctggattctacctttagtagtatggatgaacgtgggtcccgcaggctccgaggggagggctggagtggngccatcagtgaaagaagataggaactgagacacactaagtgtggactcgtggtaggaacggggcccgtattacccgacctagtccctaccaaggaacgaaccaaaccgaccaaaagtaacctcgaactgtactcctaggacaaatgaaactgtacngaagagtcgaggacncggntgtgttattagttggngggcgggnggcgcggttggggtcgcttcgagttcgtaacggttcggtcggggg

SEQ ID NO: 360302 - DNA, 593 bp, Homo sapiens
  misc_feature: GZ8MTXP01AFJ5Y.44.72.G06.1.454.CMB.2.raw
  modified_base (302)..(302): a, c, t, g, unknown or other
  misc_feature (302)..(302): n is a, c, g, or t
  modified_base (410)..(410): a, c, t, g, unknown or other
  misc_feature (410)..(410): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggaggcttggtccaggccgtggggggtccctgagactctcctgtgcagcctcgtggattcacctttagtagtattggatgaactgggtccnccaggctccgaggggagggctgggagtgggtgccagtcataggaaagaaagagtaggaacctggaagacacactaagtgtggactcgtgtagacgggcattcacatcncagagaccaacgccaaagacctcactgtactcgtaggaacaaagtacgaaaccagtcgtaggaagtaggtaccggaaggaccacggggtctggttagttattagttgggtgggcgggggacggttcggttcggttgggggtcggtaactcgttaggttagtccgttaacgggttaacgggggg

SEQ ID NO: 360303 - DNA, 649 bp, Homo sapiens
  misc_feature: GZ8MTXP01ASNZM.44.72.G06.1.454.CMB.2.raw
  modified_base (258)..(258): a, c, t, g, unknown or other
  misc_feature (258)..(258): n is a, c, g, or t
  modified_base (295)..(295): a, c, t, g, unknown or other
  misc_feature (295)..(295): n is a, c, g, or t
  modified_base (547)..(547): a, c, t, g, unknown or other
  misc_feature (547)..(547): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggagcttggtccagccgtgggggtccctgagctctctgtgcagcctntggattcacctttagtagtatggatgaactgggtccncaggctcgagggaggctggagtgggtgccatcagtagaaagaaagagtaggaacctggagacacactaagtggtgtactcgtaggtacggaacgggtccgtattaccaacctatcccgtaccaaaggaacgaaccgtaaacccggacctaaaacggaaccttccgaaccgttaggttaacttccgtaacgggaaactaaagtacgaaacgtagttccgaggagtaacgggtcggaacgggtacgtaccggtnttaaggttagttacgttaggttgggacgggtggggaccggttcggttcgggttaagggggtctccgttcgtaggttcggtaaccggttcgggtaaccggggg

SEQ ID NO: 360304 - DNA, 450 bp, Homo sapiens
  misc_feature: GZ8MTXP01BF4DX.44.72.G06.1.454.CMB.2.raw
  modified_base (434)..(434): a, c, t, g, unknown or other
  misc_feature (434)..(434): n is a, c, g, or t
  modified_base (439)..(440): a, c, t, g, unknown or other
  misc_feature (439)..(440): n is a, c, g, or t
  modified_base (442)..(450): a, c, t, g, unknown or other
  misc_feature (442)..(450): n is a, c, g, or t
tcagacagtatatacacgaccggtgctcgatttagctacgactgcaagggaaggggctggagtgggtggccatcatgaagaaagatggaactgagacacactatgtggactctgtgaagggccgattcaccatctccagagacaacgccaagaactcactgtatctgacaaatgaacagtctgagagtcgaggacacggctgtgtatttagttgtggcgggagcgcgtggggtgctcattgactacgtggggtcagggaccctggcaccgtctcctcacgcctccaccaggccccatccggtccttcccccgtggccgcccctgcctccgaggacgccaccgtccgagccgcacgagcccggcccgtgggctcgcctggtcaaggtcttacttcctatactacgtgtctgacggtcgggctggacgaagggccnatagnngnnnnnnnnn

SEQ ID NO: 360305 - DNA, 563 bp, Homo sapiens
  misc_feature: GZ8MTXP01BYXQB.44.72.G06.1.454.CMB.2.raw
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggaggcttggtccagccgtggggggtccctgagactctcctgtgcagcctctggattcacctttagtagtattggatgaactgggtccgccgaggctccgaggggagggctggagtgggtgccatcatgaagaaagataggaactgagacacactaatgtggactcgtgtggaaggggccattccaccatcctaccagacgacaaccgccaaagactcactgtatcctaggactaaagtcgaaactgtcctaggaaggacggtcggaggacgacgggctggtgttattagttgtgggcggggaggcgttcggtgggggtgccttcgtagttcgtaacgttcggtaacggggg

SEQ ID NO: 360306 - DNA, 603 bp, Homo sapiens
  misc_feature: GZ8MTXP01CXVIA.44.72.G06.1.454.CMB.2.raw
  modified_base (502)..(502): a, c, t, g, unknown or other
  misc_feature (502)..(502): n is a, c, g, or t
  modified_base (522)..(522): a, c, t, g, unknown or other
  misc_feature (522)..(522): n is a, c, g, or t
  modified_base (527)..(527): a, c, t, g, unknown or other
  misc_feature (527)..(527): n is a, c, g, or t
  modified_base (532)..(532): a, c, t, g, unknown or other
  misc_feature (532)..(532): n is a, c, g, or t
  modified_base (560)..(560): a, c, t, g, unknown or other
  misc_feature (560)..(560): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtggggggaggcttggtccaggccgtggggggtccctggacgactctcctgtgcagcctctggattctacctttagtagtattggatgaacgtgggtccgccgaggctccggaggggaacggggcgtggggaggtggggtggcctagtcagtagaaagaaagagtaggaacctggagacacactaagtgtggactcgtggtaggaacggggccgtattccacctatccctaccgaagacgaaccaaaccgcccaaagaacctcaacttgtaatcctagggaactaaagtcgaaacngtcgagagaggtcgaggacncggtntggtnttattagttggtagggcggggaggccgnggtgggggtgccttgtagttcggtaacgttaacgggtcggggg

SEQ ID NO: 360307 - DNA, 631 bp, Homo sapiens
  misc_feature: GZ8MTXP01ANBH1.44.72.G06.1.454.CMB.2.raw
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (299)..(299): a, c, t, g, unknown or other
  misc_feature (299)..(299): n is a, c, g, or t
  modified_base (440)..(440): a, c, t, g, unknown or other
  misc_feature (440)..(440): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagcttgggttttccttgttgcttatttagaaggtgtccagtgtgaggtgcaactggtggagtcgtgggggagcttggtccaggccgtgggggtccctgagactctcctgtgcngcctntggattcacctttagtagtatggatgaactgggtccncaggctccgaggggaagggctggagtgggtctcatcccattacgtgggtggtagtgaccccaataaatgtcgcaaagacctcggtagaacggggcctcttcatcgtcctaccgagggacaattaccaagtaagttacggtntttctgctaagattagaacgacgggccgtaggccggaaggtcgggaaaccgaccgtaccgggttacccctttttaagtccgtggttcgcccgtaagggtacggggttccaccgaaaggtaaacgttaacaaaccaaattacccgtaaaagttacttaacctaacacttaggttcggaacggttaaccgggg

SEQ ID NO: 360308 - DNA, 554 bp, Homo sapiens
  misc_feature: GZ8MTXP01BOP1Z.44.72.G06.1.454.CMB.2.raw
  modified_base (299)..(299): a, c, t, g, unknown or other
  misc_feature (299)..(299): n is a, c, g, or t
  modified_base (347)..(347): a, c, t, g, unknown or other
  misc_feature (347)..(347): n is a, c, g, or t
  modified_base (419)..(419): a, c, t, g, unknown or other
  misc_feature (419)..(419): n is a, c, g, or t
  modified_base (445)..(445): a, c, t, g, unknown or other
  misc_feature (445)..(445): n is a, c, g, or t
  modified_base (470)..(470): a, c, t, g, unknown or other
  misc_feature (470)..(470): n is a, c, g, or t
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctatttagaaggtgtccagtgtgaggtgcaactggtggagtcgtgggggagcttggtccagccgtgggggtccctgagactctcctgtgcagcctctggtattctacctttagtagtattggatgaactgggtccncgaggctccgaggggaggctggagtgggtgccatcagtagaagaaagntaggaactgagacacactaatgtgctcgtgtgaagggcattcaccatccacagacgacaaccgcaaagactnactgtactcgtaggactaaatgaacngtctgagagtcgaagggacacgggntggtnttaagttnttgggcgggcgggggaggttcgcgggttgggggcgtcttcgaagtttcggaacgttaaccgggttcggggg

SEQ ID NO: 360309 - DNA, 466 bp, Homo sapiens
  misc_feature: GZ8MTXP01BIC1P.44.72.G06.1.454.CMB.2.raw
  modified_base (274)..(274): a, c, t, g, unknown or other
  misc_feature (274)..(274): n is a, c, g, or t
  modified_base (390)..(390): a, c, t, g, unknown or other
  misc_feature (390)..(390): n is a, c, g, or t
  modified_base (459)..(466): a, c, t, g, unknown or other
  misc_feature (459)..(466): n is a, c, g, or t
tcagacagtatatacacgaccggtgctcgatttagctacgactgcaagggaaaggggctggtgtgggtctcacgtattaatagtgatgggagtagcacaagctacgcggactccgtgaagggccattcaccatctccagagacaacgccaagaacacgctgtatctgacaaaatgaacagtctggagagccgaggacacggctgtgtattactgtgcaagagccggtgcgggagttcggggattgcatactactacgtacggtatggacgtcgngggaccgaaggaccgacggtcaccgtctcctcagccttccaccgaacggcccatccggtcctcccctgccgccctgcctccaggacgcacgtcgtcggggcaacgacgcggcccgngggctcgcctggtacaacgacctacttcctatactactgtacgtgacgcggctgcaaggcacggaatgnnnnnnnn

SEQ ID NO: 360310 - DNA, 680 bp, Homo sapiens
  misc_feature: GZ8MTXP01E01IQ.44.72.G06.1.454.CMB.2.raw
  modified_base (257)..(257): a, c, t, g, unknown or other
  misc_feature (257)..(257): n is a, c, g, or t
  modified_base (521)..(521): a, c, t, g, unknown or other
  misc_feature (521)..(521): n is a, c, g, or t
tcagacagtatatacacgaccggtgctcgatttagctacgactgcaaggggaaaggggagagaggagccttagccctggactccaaggcctttccacttggtgatcagcactgagcacagaggactcaccatggaattgggactgagctgggttttccttgttgctattttagaggtgtccagtgtgaggtgcaactggtggagtcgtgggggagcttggtccagccgtggggggtccctgagactctcctgtgcancctctggtattctaaccttttagtgtatgtagtagtacgtcggtaccggtccgcgacggtccggacggtaacgggggacgggtgggtacgggtgggtacgggtccgacgtacgaacgtagaaagtaaaggaaagtcgtacccggtaaacgacggaacaacctaccgtaaacttacgttggtacgtacgtacgttcggaacgttaccgggtacgtacctacctaccgtactaccgaccgtacgaacggactaacgccacgtaccncgactccactcgctacgtactccgaatcgtaacgcgtacctagtaccgtaagtacgtagggtaacctacgttaccggttaggttacgtacgggttccttagggttcgttacgggttaagggcgggttcggtcggtcggttacgtcgttaacggtccggg

SEQ ID NO: 360311 - DNA, 600 bp, Homo sapiens
  misc_feature: GZ8MTXP01CA6M9.44.72.G06.1.454.CMB.2.raw
  modified_base (370)..(370): a, c, t, g, unknown or other
  misc_feature (370)..(370): n is a, c, g, or t
tcagacagtatatacacgaccggtgctcgatttagctacgactgcaagggaaaggggagagaggagccttagccctggactccaaggcctttccacttggtgatcagcactgagcacagagtactcaccatggaattgggactgagcttgggttttccttgttgcttattttagaaggtgtccagtgtgaggtgcaacgtggtggagtcgtgggggagcttggtccagccgtgggggtccctgagactctcctgtgcagcctcgtggtacttctactttagtagtattggatgtaacgtgggtcccgccgaggctaccgagggggaacgggcgtgggaggtgggtcggcctagtcgagtagaaagaaagngtaggaacctgaagacacactaagtgtcggactcgtgtaggaacggtccattcacatcctacaaggacaaccgaacgacccaaagtacctacaagtgtaactctagggaactaaagtcgaaactgtcgtagagtacggtcgaaggactagggtctaaggttattagttagttgcgggtgggacggcttcgggtgggtgtccttgagtttacgaacggtttcgggtcgggg

SEQ ID NO: 360312 - DNA, 621 bp, Homo sapiens
  misc_feature: GZ8MTXP01DZOUB.44.72.G06.1.454.CMB.2.raw
  modified_base (306)..(306): a, c, t, g, unknown or other
  misc_feature (306)..(306): n is a, c, g, or t
  modified_base (589)..(589): a, c, t, g, unknown or other
  misc_feature (589)..(589): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagcttgggttttccttgttgcttattttagaaggtgtccagtgtgaggtgcaacgtggtggagtcgtgggggaggcttggtccaggccgtcgggggtccctgagactctcctgtgcagcctctggtacttctactttagtagtatggatgaacgtgggtccncgaggctcgaggggaggctggaggtggtcggccagtcagtaggaaagaaagagtaggtaaccaggaacgaacactactaagtggtcggactcgtaggtagggaacgggtccgtacttaccaaccgtattccgaccgaagaacgaacccgaaacgacctaaaacgaacttaccattacgtaatccttaggggaacctaaaagtcgaaacgtgtcgtaggacgtaaggtcgaacggactacggtcttaagttagttagtttagttgggtaggcggggagttcggngtggggtcgctgattcggaacgttggtcgggg

SEQ ID NO: 360313 - DNA, 799 bp, Homo sapiens
  misc_feature: GZ8MTXP01AXL41.44.72.G06.1.454.CMB.2.raw
  modified_base (259)..(259): a, c, t, g, unknown or other
  misc_feature (259)..(259): n is a, c, g, or t
tcagacagtatatacacgaccggtgctcgatttagctacgactgcaagggaaaggggagagaggagccttagccctggactccaaggcctttccacttggtgataagcactgagcacagaggactcaccatggaattgggactgagctgggttttccttgttgctattttagaaggtgtccagtgtgaggtgcaactggtggagtcgtgggggagcttggtccagccgtgggggtccctgagctctcctgtgcagcctntggattctactttagtagttatggatgaacgtcgggtcccgccgaggctaccggaggggaaggggctgggaggtggggtgccatcaagtaggaaagaaagagttagggaactaggacgaacactaacttagtggttacgggtctcgtaggtagggaacggggtaccctacgtttaccaaaccctactttaccctaaccccgaaagggaacgaaaccccaaacccggaaacccccgaaaaaacggtaacccttacccgtaaacgtttacggttaactacccgttaaggaaaccccttaaaagttacggtaaaacctagggtttaccgtaagggaacggtaacgggttaaccggaacggggttaacccgacgggggttccgttagggttcggttttaaaagtttgggttttaggggttcgggggtaacccggggggaaggggttcccgggttccgggggtttaggggggttcgggtaccgtttccgtaagggtttccgggttaaacccggtttaacgggggttcggggggtaaaccccgggg

SEQ ID NO: 360314 - DNA, 484 bp, Homo sapiens
  misc_feature: GZ8MTXP01AZQXC.44.72.G06.1.454.CMB.2.raw
  modified_base (277)..(277): a, c, t, g, unknown or other
  misc_feature (277)..(277): n is a, c, g, or t
  modified_base (472)..(484): a, c, t, g, unknown or other
  misc_feature (472)..(484): n is a, c, g, or t
tcagacagtatatacacgaccggtgctcgatttagctacgactgcaagggaaggggctggagtgggtggccatcatgaagaaagatggaactgagacacactatgtggactctgtgaagggccgattcaccatctccagagacaacgccaagaactcactgtatctgacaaatgaacagtctgagagtcgaggacacggctgtgtattattgtgcgggaggcgcgtgggtgctcattgactacgtggggtcacgggaccctggtccaccgtcctccncacgcccctccaaccgaacgggcccctacgttccggtccccttcccccgtggcccgtccccgtgccctccgacggacgtccaccctccgacgaccgccacgacggcccggtccccgtgggcctcgcccgtcggtacaaacgtcctaccttactatacttacgtgtcgtgacggcggctcggacaggcgacagagnnnnnnnnnnnnn

SEQ ID NO: 360315 - DNA, 650 bp, Homo sapiens
  misc_feature: GZ8MTXP01C50WP.44.72.G06.1.454.CMB.2.raw
  modified_base (298)..(298): a, c, t, g, unknown or other
  misc_feature (298)..(298): n is a, c, g, or t
  modified_base (331)..(331): a, c, t, g, unknown or other
  misc_feature (331)..(331): n is a, c, g, or t
  modified_base (353)..(353): a, c, t, g, unknown or other
  misc_feature (353)..(353): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggagcttggtccagccgtggggggtccctgagactctcctgtgcagcctctggattctactttagtagtatggatgaactgggtccncgaggctaccgaggggagggctgggaggtgggnggccatcagtaggaaagaaagngtacggaacctggaaacgtacaactacgtaagtgggtcggtactcgtagggtacggaacggggccgtaattcccaccgtattccaccgaagacgaaaccaacgcccaaagtacctcaacttgtaaatccgtaggaaacaaattacgaaacctagttcgtaaggaggtaaccggtacgagggaccacgggtcgttgtaggttatttaggttgggtacgggacgggggttagggccgttacgggttggggggtacgtccttagtacgtttacgggtaaccgttcgggttaaccgggggg

SEQ ID NO: 360316 - DNA, 716 bp, Homo sapiens
  misc_feature: GZ8MTXP01BPEXA.44.72.G06.1.454.CMB.2.raw
  modified_base (609)..(609): a, c, t, g, unknown or other
  misc_feature (609)..(609): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagcttgggttttccttgttgcttattttagaaggtgtccagtgtgaggtgcaacgtggtggaggtcgtgggggaggtcttggtccagccgtgggggtccctgagactctctgtgcagcctctggtattctacctttagtagtattggatgaacgtgggtccgccgaggtctaccgaggggaagggcgtgggagtggggtggccatcaagtagaaagaaagagtaggaaaccgtggagaaccgaacacgttaagttggtcggacttcgtgggtacggaaacggggcccgtaactttaccgaccctattcccgaccgaaggtaacgaacccaaaacccggcccaaaagtacccttacgaaccttaggttaactacccgttaggggaaacttaaaaacgttacggaaaacccgtggttacccgtaggaaacggtaaacgttcgggaaaccgggtaaccgaaccgggtntttaaggttgtttaaacgtttgtttgggtaacgggccgggggttaggttccggcggtttgggggtcgtcttacggtaaggttcgtaaacccggtttggttcgggggg

SEQ ID NO: 360317 - DNA, 541 bp, Homo sapiens
  misc_feature: GZ8MTXP01AKDIV.44.72.G06.1.454.CMB.2.raw
  modified_base (213)..(213): a, c, t, g, unknown or other
  misc_feature (213)..(213): n is a, c, g, or t
  modified_base (235)..(235): a, c, t, g, unknown or other
  misc_feature (235)..(235): n is a, c, g, or t
  modified_base (282)..(282): a, c, t, g, unknown or other
  misc_feature (282)..(282): n is a, c, g, or t
  modified_base (323)..(323): a, c, t, g, unknown or other
  misc_feature (323)..(323): n is a, c, g, or t
  modified_base (329)..(329): a, c, t, g, unknown or other
  misc_feature (329)..(329): n is a, c, g, or t
  modified_base (360)..(360): a, c, t, g, unknown or other
  misc_feature (360)..(360): n is a, c, g, or t
  modified_base (510)..(511): a, c, t, g, unknown or other
  misc_feature (510)..(511): n is a, c, g, or t
  modified_base (513)..(541): a, c, t, g, unknown or other
  misc_feature (513)..(541): n is a, c, g, or t
tcagacagtatatacacgaccggtgctcgatttagctacgactgcaagggaaggggctggagtgggtggccatcatgaagaaagatggaactgagacacactatgtggactctgtgaagggccattcaccatctccagagacaacgccaagaactcactgtatctgacaaatgaacagtctgagagtcgagacacggctgtgtattagttggngcgggagcgcgtggggtgcttnattgactacggtggggtacacgggtaccctggccacgtctcctgacnccctccacgaacggccctacgtcgtccttcccctaggcccnccctancgtccgacgggactccaccgtccgagacccnccacgacggtcccggtcccgtcggggactcggcccgttaggggtaaccaacgggttacctttacctttacccgtaaattaacccgttacgttcgttaccgggtacgggaccgggcggggtaccgtacgggacgaacgggtcgagagtagnngnnnnnnnnnnnnnnnnnnnnnnnnnnnnn

SEQ ID NO: 360318 - DNA, 532 bp, Homo sapiens
  misc_feature: GZ8MTXP02IN2N1.44.72.G06.1.454.CMB.2.raw
tcagacagtatatacacgaccggtgctcgatttagctacgactgcaagggaaaggggagagaggagccttagccctggactccaaggcctttccacttggtgatcagcactgagcacagaggactcaccatggaattgggactgagcgtgggtttcctgttgctatttagaaggtgtccagtgtgaggtgcaactggtggagtcgtgggggagcttggtccagcctgggggtccctgagactctcctgtgcagcctctggattcacctttagtagttattggatgaactgggtccgccaggctccgaggggaagggctggagtgggtggccatcatgaagaagatggaactgagacacactatgtggactctgtgagggcattcacatctcagagacaacgccaaagactcactgtatctgacaaatgaacagtctgagagtcgaggacacgggctaggtgttattacgttgggcggcggggacggcgtcggtggggtcgtcttcgtagtttcggaacgttacggtcggggg

SEQ ID NO: 360319 - DNA, 444 bp, Homo sapiens
  misc_feature: GZ8MTXP02GMZYL.44.72.G06.1.454.CMB.2.raw
  modified_base (439)..(444): a, c, t, g, unknown or other
  misc_feature (439)..(444): n is a, c, g, or t
tcagacagtatatacacgaccggtgctcgatttagctacgactgcaagggaaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactactactacggtatggacgtctggggccaagggaccacggtcaccgtctcctcagcttccaccaagggcccatcggtcttccccctggcgccctgctccaggacgcacctctggggcacagcggccctggggctgcctggtcaaggactacttcctatatactgtctgagcgggctggcaaggcgcatagnnnnnn

SEQ ID NO: 360320 - DNA, 418 bp, Homo sapiens
  misc_feature: GZ8MTXP02H1KZA.44.72.G06.1.454.CMB.2.raw
  modified_base (415)..(418): a, c, t, g, unknown or other
  misc_feature (415)..(418): n is a, c, g, or t
tcagacagtatatacacgaccggtgctcgatttagctacgactgcaagggaaggggctggagtgggtggccatcatgaagaaagatggaactgagacacactatgtggactctgtgaagggccgattcaccatctccagagacaacgccaagaactcactgtatctgcaaaatgaacagtctgagagtcgaggacacggctgtgtattattggtgcgggaggcgctgggtggctcattgactactggggtcagggaaccctggtcaccgtctcctcagcctccaccaaggcccatcggtctccccctggcgccctgctccaggacgccacctccgagacgcacagcggccctgggctgcctggtcaggacttactcctatatactgtctgagcgggctgggcaagggcgcatagnnnn

SEQ ID NO: 360321 - DNA, 544 bp, Homo sapiens
  misc_feature: GZ8MTXP02GWUGS.44.72.G06.1.454.CMB.2.raw
  modified_base (368)..(368): a, c, t, g, unknown or other
  misc_feature (368)..(368): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggaggcttggtccagccgtgggggtccctgagactctcctgtgcagcctctggattcacttagtagttattggatgaactgggtccgccaggctccaggggaagggctggagtggggtggccatcatgaaagaaagatggaacctgagacacactangtggactcgtgtagaagggccgattcaccatctcagagacaacgccaaagaactcaactgtaatctagacaaatacgaaacagtactgagagtccggaagaccacggcttgagtattagttgggcgggacgggacggcgtcggtgggtcgcttagagttcggacgtacggtcgggg

SEQ ID NO: 360322 - DNA, 554 bp, Homo sapiens
  misc_feature: GZ8MTXP02IVOA3.44.72.G06.1.454.CMB.2.raw
  modified_base (402)..(402): a, c, t, g, unknown or other
  misc_feature (402)..(402): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctatttagaaggtgtccagtgtgaggtgcaactggtggagtctgggggaggcttggtccagccgtggggggtccctgagactctcctgtgcagcctctggattcaccttagtagttatggatgaactgggtccgccaggctccgaggggaagggctggaggtgggtggccatcatgaaagaagatggaacctgagacacactatgtggactctgtgaagggcgattcaccatctcaganacaacgccaaagactcactgtaatctagacaaatgaaacagtctaggaagaggtacgagggaacacgggctggtagttattaagttggtaggccgggggagtccggacggtgggggtcggtctcgtaagtttcggaacttcggttacggggg

SEQ ID NO: 360323 - DNA, 416 bp, Homo sapiens
  misc_feature: GZ8MTXP02G33J0.44.72.G06.1.454.CMB.2.raw
  modified_base (413)..(416): a, c, t, g, unknown or other
  misc_feature (413)..(416): n is a, c, g, or t
tcagacagtatatacacgaccggtgctcgatttagctacgactgcaagggaaggggctggagtgggtggccatcatgaagaaagatggaactgagacacactatgtggactctgtgaagggccgattcaccatctccagagacaacgccaagaactcactgtatctgcaaatgaacagtctgagagtcgaggacacggctgtgtattattgtgcgggaggcgctggggtggctcattgactactggggtcagggaaccctggtcaccgtctcctcagcctccaccaagggcccatccggtcttccccctggcgccctgctccaggagcacctccgagacgcacagccggcctgggctcgcctggtcaggactactcctatatactgtctgagcgggctgggcaaggcgcatgnnnn

SEQ ID NO: 360324 - DNA, 577 bp, Homo sapiens
  misc_feature: GZ8MTXP02HXQ4V.44.72.G06.1.454.CMB.2.raw
  modified_base (348)..(348): a, c, t, g, unknown or other
  misc_feature (348)..(348): n is a, c, g, or t
  modified_base (371)..(371): a, c, t, g, unknown or other
  misc_feature (371)..(371): n is a, c, g, or t
  modified_base (468)..(468): a, c, t, g, unknown or other
  misc_feature (468)..(468): n is a, c, g, or t
  modified_base (533)..(533): a, c, t, g, unknown or other
  misc_feature (533)..(533): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggaggcttggtccagccgtgggggtccctgagactctcctgtgcagcctctggattcacctttagtagttatggatgaactgggtccgccaggctccgaggggagggctggagtgggtggccatcatgaaagaaagngtaggaacctgagacacacttangtggactcgtgtggaagggccgattccgaaccatcctcccaggacgaaccaaacggcccaaagaacctcgactgtaattcctagacaaaatgaaacngtcagagacgtcggaggacgacggcttagtgtttaattacgttggtacggcgggggtacgccggngttgggggtcgacttcgtaagtttcgaacgtttacggtcggggg

SEQ ID NO: 360325 - DNA, 691 bp, Homo sapiens
  misc_feature: GZ8MTXP02GIDOJ.44.72.G06.1.454.CMB.2.raw
  modified_base (298)..(298): a, c, t, g, unknown or other
  misc_feature (298)..(298): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggaggcttggtccagccgtgggggtccctgagactctcctgtgcagcctctggattcacctttagtagttatggatgaactggtccncaggctccaggggagggctggagtgggtggccatcagtgaaagaagatggaacctgagacacactagtggtgggactcgtaggtaggaacggggccgtaagtttccaaccctattcccgtacccgaaggaacgaacccaaaacccgggcccaaaaggtaaaccccttccgaaaccttagggttaaacttcccgtaggtaacctaaaaagttacgggaaaaccctaggttacccttagggaaggtaccggttaacgggaagggaacccgaacggggtcttagggttacgtttaaagtttttacgttggggttcggggacgggggaacgggtcccggttacggtggggggttcgcgtttaccgtagtttacggaaccgtttacgggtaacggggg

SEQ ID NO: 360326 - DNA, 651 bp, Homo sapiens
  misc_feature: GZ8MTXP02I7Y8J.44.72.G06.1.454.CMB.2.raw
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggagcttggtccagccgtgggggtccctgagactctcctgtgcagcctctggtattctacctttagtagttattggatgaacgtgggtccgccgaggcctccgaggggaagggcgtgggaggtggggtggccatcagtagaaagaagagtggaactgaagacatactatggtggaccttgtaggtaggaacgggccgtattccaacctattacccgacccgaaggaacgaaacccaaacggacccaaaagaacctcaactgtattccagtaaccaaagtacgaacctaggttcagggaaagacgggtaccgaaggaaccgtcgggtacttggttaagtttacctttagtgggtacggggacggggtaacgggccggttaggtgggggtttcgcccgtttacgtaaggttttacggaacccgtttagggggtaaccggggg

SEQ ID NO: 360327 - DNA, 528 bp, Homo sapiens
  misc_feature: GZ8MTXP02FRIOQ.44.72.G06.1.454.CMB.2.raw
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (460)..(460): a, c, t, g, unknown or other
  misc_feature (460)..(460): n is a, c, g, or t
  modified_base (469)..(469): a, c, t, g, unknown or other
  misc_feature (469)..(469): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaggtgtccagtgtgaggtgcaactggtggagtcgtgggggaggcttggtccagccgtggggggtccctgagactctcctgtgcagcctctggattcacctttagtagttattggatgaactgggtccgccaggctcgaggggagggctggagtgggtggccatcatgaaagaagatggaacctgagacacactatgtggactcgtgtgaacgggcattcaccntccncaganacacgcaagaactcactgtatctagacaaatgaaacagtcagagagtcggaggacncggctggtntatttagtggtggcgggaggcgtcggtggggtcgctacgagtttcgactacggtggggg

SEQ ID NO: 360328 - DNA, 576 bp, Homo sapiens
  misc_feature: GZ8MTXP02HWROO.44.72.G06.1.454.CMB.2.raw
  modified_base (298)..(298): a, c, t, g, unknown or other
  misc_feature (298)..(298): n is a, c, g, or t
  modified_base (454)..(454): a, c, t, g, unknown or other
  misc_feature (454)..(454): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctatttagaaggtgtccagtgtgaggtgcaactggtggagtcgtgggggagcttggtccagccgtgggggtccctgagactctcctgtgcagcctctggattcacctttagtagttatggatgaacgtgggtccncaggctccgaggggagggctggagtgggtggccatcatgaaagaaagatggaactgagacaacactagtgtggactctgaggaaggggccattccaccatcctacaagagaaccaaacgcccaaagactcatgtaattctagacaaaatgaaaccngtacaggaagtagtacggaggaaccgacgggctttaggtaggtttaattagttggggtacggccgggggagccggtacggtgggggttcggcttcgaagtttcggaacgttcggtacggggg

SEQ ID NO: 360329 - DNA, 617 bp, Homo sapiens
  misc_feature: GZ8MTXP02HQCMN.44.72.G06.1.454.CMB.2.raw
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtcagtgtgaggtgcaactggtggagtcgtgggggaggcttggtccagccgtggggggtccctgagctctcctgtgcagcctctggattcacctttagtagttattggatgaacgtgggtccgccaggctccgaggggaggggctgggaggtggggtggccagtcagtaggaaagaaagagtaggaacctgagacaacactagtgtggactcgtggtaggaacggggccgaatttccaacctatcctacccgaaggaacgaacccaaacgacccaaaagtaacctcaactgtaacttcctagaactaaaagtcgaaacagttcaggaagaggtacggaaaggaccgacggtcgttaggttaggttaattagttgggtacggcgggggaggtccgtgggtgggggtcgcttacgagtttcggaacgtttacgggtcggggg

SEQ ID NO: 360330 - DNA, 600 bp, Homo sapiens
  misc_feature: GZ8MTXP02IM8UM.44.72.G06.1.454.CMB.2.raw
  modified_base (451)..(451): a, c, t, g, unknown or other
  misc_feature (451)..(451): n is a, c, g, or t
  modified_base (548)..(548): a, c, t, g, unknown or other
  misc_feature (548)..(548): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctatttagaaggtgtccagtgtgaggtgcaactggtggagtcgtgggggaggcttggtccagccgtggggggtccctggagactctcctgtgcagcctctggattcacctttagtagttatggatgaactgggtccgccaggctccgaggggaagggcgtgggaggtggggtcggccagtcagtaggaaagaaagagtaggaacctgaagacacactaagtgtggactctggtagaaggggcctattcaacccatccctacgagacaacgaaccgaccaaagacctanactgtaatctagtacaaaatcgaaactagtactagaagacgtcgaaggaccgacggcgttagtagttatttatgggtcgggaccgggggagtccggnggttggggtcggtcttacgaagttttcggaaaccttttccggggtacggggg

SEQ ID NO: 360331 - DNA, 456 bp, Homo sapiens
  misc_feature: GZ8MTXP02HPAOY.44.72.G06.1.454.CMB.2.raw
  modified_base (448)..(456): a, c, t, g, unknown or other
  misc_feature (448)..(456): n is a, c, g, or t
tcagacagtatatacacgaccggtgctcgatttagctacgactgcaagggaaaggggctggtgtgggtctcacgtattaatagtgatgggagtagcacaagctacgcggactccgtgaagggccgattcaccatctccagagactaacgccaagaacacgctgtatctgcaaatgaacagtctgagagccgaggacacggctgtgtattactgtgcaagagccggtgcgggagttcggggattgcatactactactacggtatggacgtcgtggggccaagggaccacggtcaccgtctcctcagcttccaccaagggcccatcggtctcccctggcgccctgcctccaggcgcacctcgtcgggggcacgagccgggccctggggctcgccctggtcaaggacttactcctatatactgtctgagcgggctggcaaggcgcagtagnnnnnnnnn

SEQ ID NO: 360332 - DNA, 561 bp, Homo sapiens
  misc_feature: GZ8MTXP02FZB01.44.72.G06.1.454.CMB.2.raw
  modified_base (443)..(443): a, c, t, g, unknown or other
  misc_feature (443)..(443): n is a, c, g, or t
  modified_base (456)..(456): a, c, t, g, unknown or other
  misc_feature (456)..(456): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggaggcttggtccagccgtgggggtccctgagactctcctgtgcagcctctggattcacctttagtagttattggatgaactggtccgccaggctccgaggggaagggctggagtgggtggccatcatgaaagaagatggaacctgagacacactatgtggactcgtgtagaaggggccgattccaaccattcctacccaagagaccaaacgccaaagaactcactgtatcngacaaatgaaacngtctgagagtcgaggaccgacgtgtgttagtagtttagtgggacggtcggggagcggtcgggtggggtacgcttcgtagtacggtaccttacggggtaccggggg

SEQ ID NO: 360333 - DNA, 599 bp, Homo sapiens
  misc_feature: GZ8MTXP02FMN3M.44.72.G06.1.454.CMB.2.raw
  modified_base (261)..(261): a, c, t, g, unknown or other
  misc_feature (261)..(261): n is a, c, g, or t
  modified_base (518)..(518): a, c, t, g, unknown or other
  misc_feature (518)..(518): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggaggcttggtccagccgtgggggtccctgagactctcctgtgcagcctntggattcacctttagtagttattggatgaactgggtccgcaggctccgaggggagggctggaggtgggtggccatcatgaaagaaagatggaacctgagacacactatgtggactcgtgtaggaacgggtcgattccaacctatccctaccgaagacgaaccgaaaccgccaaaagtaacctcaacctgtaactcctagacctaaaatacgaaaaccgtagtacgtagagtaggtaccggaaggaaccgaccgggtnttaggttagtttattggtggtcgggcggggacggtcggtcgggtggggtcgtctcgtagttacggtacgttacggtcgggg

SEQ ID NO: 360334 - DNA, 605 bp, Homo sapiens
  misc_feature: GZ8MTXP02IT09J.44.72.G06.1.454.CMB.2.raw
  modified_base (304)..(304): a, c, t, g, unknown or other
  misc_feature (304)..(304): n is a, c, g, or t
  modified_base (413)..(413): a, c, t, g, unknown or other
  misc_feature (413)..(413): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggaggcttggtccaggccgtggggggtccctggagactctcctgtgcagcctctggattctacctttagtagttattggatgaactgggtccncaggctaccgaggggagggctggagtgggtgccatcatgaaagaaagagtggaacctgagacacactatgtggactctggtagaacggggcctattccaactacttccncccaaaggacaaccaaacggcccaaagacctcactgtaatcctagactaaaatcggaaactagtcgtaggaagaggtacggaggaaccgtacgggcttaggttaggttaaatttcgtgggtcggacgggggaggtcccgtggtggggggtacgccgttacgtagtttacggaaccggtttacggtcgggggg

SEQ ID NO: 360335 - DNA, 576 bp, Homo sapiens
  misc_feature: GZ8MTXP02IFZOA.44.72.G06.1.454.CMB.2.raw
  modified_base (404)..(404): a, c, t, g, unknown or other
  misc_feature (404)..(404): n is a, c, g, or t
  modified_base (464)..(464): a, c, t, g, unknown or other
  misc_feature (464)..(464): n is a, c, g, or t
  modified_base (494)..(494): a, c, t, g, unknown or other
  misc_feature (494)..(494): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctatttagaaggtgtccagtgtgaggtgcaactggtggagtcgtgggggagcttggtccagccgtgggggtccctgagactctcctgtgcagcctctggattcacctttagtagttatggatgaactggtccgcaggctccgaggggagggctgggagtggggtggccatcgagtagaaagaaagagtaggaacctgacgacacactatgtggactctgtagaacggggccattccacctntcctaccagagacaacgtcccaaagaacctcaactgtaactctagactaaaatcgaaacngtctggaagaggtcggaaggacgacgggtnttagtagttattagttcggcgggtacggggaggtcgtggttggggtcgtacttacgtagtttcggacgtttacgggtcgggg

SEQ ID NO: 360336 - DNA, 527 bp, Homo sapiens
  misc_feature: GZ8MTXP02IF0T4.44.72.G06.1.454.CMB.2.raw
  modified_base (402)..(402): a, c, t, g, unknown or other
  misc_feature (402)..(402): n is a, c, g, or t
  modified_base (411)..(411): a, c, t, g, unknown or other
  misc_feature (411)..(411): n is a, c, g, or t
  modified_base (499)..(499): a, c, t, g, unknown or other
  misc_feature (499)..(499): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggagcttggtccagccgtggggggtccctgagactctcctgtgcagcctctggattctacctttagtagttattggatgaactgggtccgcaggctcgaggggaagggctgggaggtgggtggccatcagtgaaagaaagagtaggaacctgagacacactatgtggactgtggtagaggggccatcaccntcctcaganacaacgcaaagactcactgtatctagacaaatcgaaacagtcagagagtacgaggacaggctagtagtattagtgcggcggggagcgngtgggcgctcgattcgactaggtcgggg

SEQ ID NO: 360337 - DNA, 588 bp, Homo sapiens
  misc_feature: GZ8MTXP02GTYHX.44.72.G06.1.454.CMB.2.raw
  modified_base (375)..(375): a, c, t, g, unknown or other
  misc_feature (375)..(375): n is a, c, g, or t
  modified_base (515)..(515): a, c, t, g, unknown or other
  misc_feature (515)..(515): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggaggcttggtccagccgtgggggtccctgagactctcctgtgcagcctctggattcactttagtagttattggatgaactgggtccgccaggctccgaggggaagggctggaggtgggtggccatcatgaaagaaagagtaggaacctgaagacacactatgnggactcgtggtagaacggggtccgattccgaacctattccctaccgaaggaacgaacaaaccgcccaaaagaacccttcaacgttgtaaactcctaaggacaaaatcgaaacagtctaggagagtacgaggacacggttnttagtattagttgttggcgggacggggcgtcggtggttggggctactcgtagtacggtacgttacgggtcggg

SEQ ID NO: 360338 - DNA, 612 bp, Homo sapiens
  misc_feature: GZ8MTXP02GCCO9.44.72.G06.1.454.CMB.2.raw
  modified_base (516)..(516): a, c, t, g, unknown or other
  misc_feature (516)..(516): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactgggtggagtcgtgggggagcttggtccagccgtgggggtccctggagactctcctgtgcagcctctggattcacctttagtagttattggatgaactgggtccgccaggctccgaggggagggctgggagtggggtggccatcagtgaaagaaagagtaggaacctgaagacactactagtggtggactcgtgtacgaacggggccgattccaaccatcctacccgaaaggacgaaaccgaacccggacctaaaagaacctcaactgtatcctagactaaatacgaaactgtctaggagagtacgaaggacgtcgggtntagttagttagttagtgggtacgggacggggtacggtccggtggtcgggggtcgtaccgttacgttagtttaccggaacggtttacgggtcggggg

SEQ ID NO: 360339 - DNA, 623 bp, Homo sapiens
  misc_feature: GZ8MTXP02HVNNU.44.72.G06.1.454.CMB.2.raw
  modified_base (347)..(347): a, c, t, g, unknown or other
  misc_feature (347)..(347): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtctgggggaggcttggtccagccgtggggggtccctgagactctcctgtgcagcctctggattcacctttagtagttattgggatgaactgggtccgcaggctccaggggagggctggagtgggtggccatcatgaagaaagntaggaacctgagacacactagtgtggacttctgtaggaaaggggcccgaatttccgaacctatccctacccaaggaacgaccaaaacggccaaaaggaacctcacttggtaacttcctaggactaaaatcggaaactagtccgtaggaagtagtcggaagggaccaacgggggtctagggttagttaagtttaagttgggttggaccggggggtaggccggtcgggttgggggtcgggccttcgaagtttcggaaaacgtttacgggttcgggggg

SEQ ID NO: 360340 - DNA, 500 bp, Homo sapiens
  misc_feature: GZ8MTXP02G152L.44.72.G06.1.454.CMB.2.raw
  modified_base (481)..(500): a, c, t, g, unknown or other
  misc_feature (481)..(500): n is a, c, g, or t
tcagacagtatatacacgaccggtgctcgatttagctacgactgcaagggaaaggggctggtgtgggtctcacgtattaatagtgatgggagtagcacaagctacgcggactccgtgaagggccgattcaccatctccagagacaacgccaagaacacgctgtatctgcaaaatgaacagtctgagagccgaggacacggctgtgtattactgtgcaagagccggtgcgggagttcggggattgcatactactactacggtatggacgtctggggccgaagggaccacggtcaccgtctcctcagcttccaccgaaggcccatcgtccttcccctggccgccctgcctccaggcgcacctcgtcgggggcacgacgcggccgagtcgggctcgccgtgggttcaaacgggtacttaccttaccctatattaacctgttccgtaggacggccggggctcgggacgaaacgggcgacagtagnnnnnnnnnnnnnnnnnnnn

SEQ ID NO: 360341 - DNA, 590 bp, Homo sapiens
  misc_feature: GZ8MTXP02IAG91.44.72.G06.1.454.CMB.2.raw
  modified_base (370)..(370): a, c, t, g, unknown or other
  misc_feature (370)..(370): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggaggcttggtccagccgtgggggtccctgagactctcctgtgcagcctctggattcactttagtagttatggatgaactggtccgcaggctccgaggggaaggggctgggaggtggggtggccatcatgaaagaaagatggaacctgagacacactangtggactctgtagaaggggccaattccaacccgtatcctaccgagacgaacaaaccggaccaaagaactcacttgtaactctgaaccaaaagtcgaaacagtcctagagtagtacggaggacgacgggtcttaggtagtttattagtttcggggcgggacggggacggtccggaggtgggggtcgtactacgtagtttcggtaacgtttacgggtcgggg

SEQ ID NO: 360342 - DNA, 588 bp, Homo sapiens
  misc_feature: GZ8MTXP02HCGK9.44.72.G06.1.454.CMB.2.raw
  modified_base (298)..(298): a, c, t, g, unknown or other
  misc_feature (298)..(298): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggagcttggtccagccgtgggggtccctgagactctcctgtgcagcctctggattcacctttagtagttatggatgaactgggtccnccaggctccgaggggaagggctgggagtggggtggccagtcataggaaagaaagataggaacctgaagacaacactatggtggtactcgtggtaggaacggggccgattccaccattccacccgaagacgaacctaacggccaaagaacctcactgtaatctagactaaatgaaactgtactagacggtagtaccggaagaccgacgggtctaggttagttattagtttggacggcgggggaagtcggcgtgggggttcgctactaagttcgaacgttaacggtcggggg

SEQ ID NO: 360343 - DNA, 580 bp, Homo sapiens
  misc_feature: GZ8MTXP02G95F4.44.72.G06.1.454.CMB.2.raw
  modified_base (307)..(307): a, c, t, g, unknown or other
  misc_feature (307)..(307): n is a, c, g, or t
  modified_base (377)..(377): a, c, t, g, unknown or other
  misc_feature (377)..(377): n is a, c, g, or t
  modified_base (417)..(417): a, c, t, g, unknown or other
  misc_feature (417)..(417): n is a, c, g, or t
  modified_base (507)..(507): a, c, t, g, unknown or other
  misc_feature (507)..(507): n is a, c, g, or t
  modified_base (550)..(550): a, c, t, g, unknown or other
  misc_feature (550)..(550): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaacgtggtggagtcgtgggggagtcgttggtccaggccgtgggggtccctgagctctcctgtgcagcctcgtggtacttctacctttagtagttattggatgaacgtgggtccnccaggcctccggaggggaacgggcgtgggaggtgggtcgccatcagtagaaagaagagtaggaacctganacacactatgtggactcgtgtagagggtcctattcaaccntccaccaagacaaccgaacgaccaaagacctcagtgtaatcctagaactaaagtgaacctagtcgtaggagacggtacgacggacgtcgnttagtattaagttgttcggcggcgggacggcgtggtggggtcnctagtagtttacgaacgtcgggtaccgggg

SEQ ID NO: 360344 - DNA, 575 bp, Homo sapiens
  misc_feature: GZ8MTXP02F30DR.44.72.G06.1.454.CMB.2.raw
  modified_base (405)..(405): a, c, t, g, unknown or other
  misc_feature (405)..(405): n is a, c, g, or t
  modified_base (540)..(540): a, c, t, g, unknown or other
  misc_feature (540)..(540): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggaggcttggtccagccgtggggggtccctgagactctcctgtgcagcctctggattcacctttagtagttattggatgaactgggtccgccaggctccgaggggagggctggagtgggtggccatcatgaaagaaagagtggaacctgagacacactatgtggactctgtgaagggccgattcaacctatccnccagacgacaacgccaaagactcaaactgtaatctgaacaaagtcgaaactagtcgagaagaggttcgaaggacctacgggcttaggtagttaactttagtgggtacggcgggggtaagccggtgtggggggtcncgttacaggtttcgaacccgtttacggtagggggg

SEQ ID NO: 360345 - DNA, 593 bp, Homo sapiens
  misc_feature: GZ8MTXP02HQ640.44.72.G06.1.454.CMB.2.raw
  modified_base (266)..(266): a, c, t, g, unknown or other
  misc_feature (266)..(266): n is a, c, g, or t
  modified_base (461)..(461): a, c, t, g, unknown or other
  misc_feature (461)..(461): n is a, c, g, or t
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (490)..(490): a, c, t, g, unknown or other
  misc_feature (490)..(490): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagcttgggttttccttgttgcttattttagaaggtgtccagtgtgaggtgcaatgggtggagtcgtgggggaggcttggtccaggccgtggggggtccctggagactctcctgtgcagcctntggattcacctttagtagttattggatgaacgtgggtcccgcaggctccgaaggggaagggctgggaggtggggtggccatcaatggaaaagaaagagtaggaacctgaagacacactagtggtgaactgtagtaggaacgggccgaattccaaaccctatcctaccaagagaaccaaaccgcccaaaagtaacnccgatgttaaaccnctaagaanaaanaanaacagtagagagagagagacgacgacgtagtagttagttagtggtacggacgggacggcggtcggtgggtcggtacgtacgtagtacgtacgtacggtacggg

SEQ ID NO: 360346 - DNA, 419 bp, Homo sapiens
  misc_feature: GZ8MTXP02FO28O.44.72.G06.1.454.CMB.2.raw
  modified_base (413)..(419): a, c, t, g, unknown or other
  misc_feature (413)..(419): n is a, c, g, or t
tcagacagtatatacacgaccggtgctcgatttagctacgactgcaagggaagggctggagtgggtggccatcatgaagaaagatggaactgagacacactatgtggactctgtgaagggccgattcaccatctccagagacaacgccaagaactcactgtatctgcaaatgaacagtctgagagtcgagacacggctgtgtattattgtgcgggaggcgctgggtggctcattgactactggggtcagggaacccctggtcaccgtctcctcagcctccaccaagggccccatcggtctccccctggcgccctgctccaggagcaccgtccgagacgcacagcggccctggggctgcctggtcaagactacttcctatatactgtctgagcgggctggcaaaggcgcatagnnnnnnn

SEQ ID NO: 360347 - DNA, 576 bp, Homo sapiens
  misc_feature: GZ8MTXP02G7TU4.44.72.G06.1.454.CMB.2.raw
  modified_base (298)..(298): a, c, t, g, unknown or other
  misc_feature (298)..(298): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggagcttggtccagccgtgggggtccctgagactctcctgtgcagcctctggacttctactttagtagttatggatgactgggtccncgaggctcgaggggagggctgggaggtgggtcgccatcagtagaaagaagagtaggaacctgaacgacactactagtgtcggactcgtggtaggaacggggccgtattccaacctatccctacgagacaaccaacgacccaagaacctcaaccgttgtaacttcagaactaaagtgaactagttcaaggagtagtacggagacgagtctagtgttattgttggcggacggggcggtcgtcggtgggtcgtcgtacgtacgtacggtacgtcgggtcgg

SEQ ID NO: 360348 - DNA, 654 bp, Homo sapiens
  misc_feature: GZ8MTXP02JXSYH.44.72.G06.1.454.CMB.2.raw
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttcctgttgctattttagaaggtgtccagtgtgaggtgcaactggtggagtcgtgggggagcttggtccaggccgtgggggtccctgacgactctctgtgcagcctctggattctaccttagtattatggatgacgtggtccgcaggcctcgaggggagggctgggaggtgggtgccagtcgagtaggaaagaaagagtacggaacctggaagaccaactactaagtggtcggtactgtgggtagggaacggggcccgtagttacccaaccgtacttcccgtaacccgaagaaccggaaacccaaacccgacccgtaaaacggaacctaccacgttagttactaccgtaggactaaaagtcgaaaacgtgtaccgtagggaaggtacggacggaacggacgtaaccggtgttcggtagttaacgtttagttcgggacgggcgggggcgtcgtacggtgggggtcgtaccttcggaatttcggaccggttagggtccggggg

SEQ ID NO: 360349 - DNA, 541 bp, Homo sapiens
  misc_feature: GZ8MTXP02IQ4O1.44.72.G06.1.454.CMB.2.raw
  modified_base (297)..(297): a, c, t, g, unknown or other
  misc_feature (297)..(297): n is a, c, g, or t
  modified_base (469)..(469): a, c, t, g, unknown or other
  misc_feature (469)..(469): n is a, c, g, or t
  modified_base (499)..(499): a, c, t, g, unknown or other
  misc_feature (499)..(499): n is a, c, g, or t
  modified_base (517)..(517): a, c, t, g, unknown or other
  misc_feature (517)..(517): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggtttcctgttgctatttagaaggtgtccagtgtgaggtgcaactggtggagtcgtgggggagcttggtccaggccgtgggggtccctgagactctcctgtgcagcctgtggattctacctttagtagttatggatgaactgggtccncaggctccgagggaaggggctggaggtgggtggccagtcagtgaaagaaagagtaggaaccctgacacacactagtgtcggactcgtgtagacggggcattccaccatccacagacgaacaaacgccaaagaactcactgtaactctagactaaatggaacagtctagaagngtacggagacacggctgagttattgtaggnggtcgggagcgtgtgggngctgagttcgaacgttagtcgggg

SEQ ID NO: 360350 - DNA, 708 bp, Homo sapiens
  misc_feature: GZ8MTXP02FO4YB.44.72.G06.1.454.CMB.2.raw
  modified_base (299)..(299): a, c, t, g, unknown or other
  misc_feature (299)..(299): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtcgtgggggagcttggtccagccgtgggggtccctgagctctcctgtgcagcctctggattcacctttagtagttattggatgaacgtgggtccncaggctaccgaggggaagggctggagtggggtgccatcagtgaaagaagatggaacctgagacactactatgtggactgtagtaggaacgggccgattaccgaaccctattccctaccgaaaggaacgaaacccgaaaccggaccccaaaaggtaaacccttcaaaaccttggttaaaccttccgtaaacggaacctaaaaagttggaaaacccgtagttaccgtagggaaaggtaccgggttaaccggaagggtaaacccgacgggggtacttaggggttacgtttaaagttttaacggttggggttaacggggaccggggggtaacggtcccgggttaccggggttggggggttccgtcccgttacggttaagtttacgggaaccgtttaacggggtttacgggggg

SEQ ID NO: 360351 - DNA, 621 bp, Homo sapiens
  misc_feature: GZ8MTXP02J3UM0.44.72.G06.1.454.CMB.2.raw
  modified_base (362)..(362): a, c, t, g, unknown or other
  misc_feature (362)..(362): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
  modified_base (517)..(517): a, c, t, g, unknown or other
  misc_feature (517)..(517): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagtctgggttttccttgttgcttattttagaaggtgtccagtgtgaggtgcaacgtggtggagtcgtgggggagtcttggtccaggtcccgtgggggtcccctgacgactctcctgtaggcagtcctctggtattcactttagagttatggatcgacgtggtccgctaggctaccggaggggacggctaggagtggtcgccatcagtagaaagaaagntacggaacctagacgtacacgtactagtgtcggacttcgtaggtacgaacgggcctaattccaaacctagtcctacgagacgacacggtcaaagactcgactgactcagacaatcgaangttacnggaacgcgtacgggacgactaccggggttnttaggtacgtttagttacggtcgggtcggggaccggggtacggtccggtacgggtgggtaccgtacttacggtaacggtttccggaccgtttacgggtcggggg

SEQ ID NO: 360352 - DNA, 719 bp, Homo sapiens
  misc_feature: GZ8MTXP02HZG1I.44.72.G06.1.454.CMB.2.raw
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (606)..(606): a, c, t, g, unknown or other
  misc_feature (606)..(606): n is a, c, g, or t
tcagacagtatatacacgaccggtgctcgatttagctacgactgcaagggaaaggggagagaggagccttagccctggactccaaggccttttccacttggtgatcagcactgagcacagaggactcaccatggaattgggactgagcttgggttttccttgttgcttattttagaaggtgtccagtgtgaggtgcaacgtggtggagtcggtgggggaggtcgttggtccaggccgtggggggtccctggagtactctccgtgtgcncgcctcgtggnttctacctttagtagttattggatgaacgtcgggtccgcgaggcctaccggaggggacggggcgtgggaggtggggtcggccagtcgagtagaaaggaaaagtagtaggaactagaacgaccactacgtagtcggttcgggacttgtacggtagggaacggggtccgtaacttcccgaacctactccctaaccgaaggaccaaacccgaaaccggaacccaaaaggtaacccttaccgaacgttagttaaacttcctaaggaaaccttaaaagtcggaaaacctggtacgtaggaaaggtacggtacggaacgggtactaccgggtntttacgggtagttttaagttagttggggtacgggtaccgggggaggttccgggtacggttgggggtaccgtacgttaccggtaagtttcggtaaccgtttacggggtcggggg

SEQ ID NO: 360353 - DNA, 624 bp, Homo sapiens
  misc_feature: GZ8MTXP02JBD6U.44.72.G06.1.454.CMB.2.raw
  modified_base (310)..(310): a, c, t, g, unknown or other
  misc_feature (310)..(310): n is a, c, g, or t
  modified_base (491)..(491): a, c, t, g, unknown or other
  misc_feature (491)..(491): n is a, c, g, or t
  modified_base (534)..(534): a, c, t, g, unknown or other
  misc_feature (534)..(534): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctatttagaaggtgtccagtgtgaggtgcaacgtggtggagtcgtgggggagtcttggtccaggccgtgggggtccctgagactctcctgtgcacgcctcgtggacttctacctttagtagttattggatagaaccgtcgggtcccncgaggcctccgaggggaacgggcgtgggacggtggggtcggacctagtcaagtagaaaagtaagagtaggaaccctgacgaacacactagtggtggtacttgtaggtagaacgggtcgtacttccaactctcctaccgagtaacaaccgaacacccaaagaacctcaacttgaactcgtanacgtaaaagtgaaactagtcgtagacgtaggtacggagaccgngctagttgtaatttggtacgtgggacgggacggtcggtccggttggggcgtccgtaacggtgtttacggtaaccgtcgggttaccggggg

SEQ ID NO: 360354 - DNA, 668 bp, Homo sapiens
  misc_feature: GZ8MTXP02FYC0F.44.72.G06.1.454.CMB.2.raw
  modified_base (376)..(376): a, c, t, g, unknown or other
  misc_feature (376)..(376): n is a, c, g, or t
  modified_base (501)..(501): a, c, t, g, unknown or other
  misc_feature (501)..(501): n is a, c, g, or t
tcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgcttattttagaaggtgtccagtgtgaggtgcaactgggtggagtcgtgggggagtcgttggtccagccggtgggggtccctggacgtactctcctgtgcagcctcgtggtacttctacctttagtagttagttggatgaacgtcgggtccgccgaggctaccgagggggaagggtcgtgggaggtggggcgcctatcgagtaggaaagaaagngtaggaactgacgacacactagtgtcggactcgtgtacggaaacgggtcctattccgaaccctatccctacgaaagacgaaccaaaccgccaaaaggtaaacctcgaaacgttgtaaactcgtanaaactaaactaggaaacctaggtaccgttagaacgggtacggtaacggcggttaacgacggggttctaggtttaggtttaaattggttcgggacgggtcgggggactcccggggttaggttaacggggtcgacttagtacggttacgacggtttacggtaacggggg

SEQ ID NO: 360355 - DNA, 528 bp, Homo sapiens
  misc_feature: GZ8MTXP01D5JO8.2.16.B05.1.454.CMB.2.raw
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
  modified_base (472)..(472): a, c, t, g, unknown or other
  misc_feature (472)..(472): n is a, c, g, or t
  modified_base (486)..(486): a, c, t, g, unknown or other
  misc_feature (486)..(486): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgccattttagaaggtgtccagtgtgaggtgcagctggtggagtcgtgggggaggtttggtccagccgtggggggtccctgagactctcgtgtgcggcctctggattcatctctacaaactattggatgagctgggtccgtcaggctccgagggagggctgggagtgggtgccagcagtgaacggagagtggaagtacaaaagaactatgtggactcgtgtgaagggccgattcacatctccaganacaacgccaagactnactggtatctgacaaatgaacagacctaagacccgagacacggctgngtattcgtgtgcgngacgccgctaacgtcgggggcccggagtccccgttgggtccc

SEQ ID NO: 360356 - DNA, 515 bp, Homo sapiens
  misc_feature: GZ8MTXP01EDSX0.2.16.B05.1.454.CMB.2.raw
  modified_base (377)..(377): a, c, t, g, unknown or other
  misc_feature (377)..(377): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
  modified_base (479)..(479): a, c, t, g, unknown or other
  misc_feature (479)..(479): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcgtggtttcgtgtagccatttagaaggtgtcagtgtgaggtgcagctggtggagtcgtgggggaggtttggtccagccgtggggggtccctgagactctcgtgtgcggcctctggattcatctctacaaactattggatgagctgggtccgtcaggctccgaggggaagggctggagtgggtggccagcagtgaacggagatggaagtacaaaagctatgtggactntgtgagggcatcacatcncaganacaacgccaaanactcactggtatcngacaanagaacacgacaacgaacgacgacgacgcgtgttgtattagtgtgcgngacgaacgcgtcgcgggccgggcggtccgttcgtcg

SEQ ID NO: 360357 - DNA, 580 bp, Homo sapiens
  misc_feature: GZ8MTXP01CVC7U.2.16.B05.1.454.CMB.2.raw
  modified_base (540)..(540): a, c, t, g, unknown or other
  misc_feature (540)..(540): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctgggtggagtcgtggggggaggtttggtccaggccgtggggggtccctgagactctcgtgtgcggcctctggattcatctctaacaaactattggatgagcgtgggtccgtcaggctccgagggggaaggggctgggaggtgggggtggccagcagtcggaaacgggagagtagggaaagtaacaaaaagaactagtggtagggactcgtggtaggaaaggggcctattccaacctatcctaccaagacgaacaacgaccaaagaactcaacttggtaatctagacaaaatgaaacagaccctaaagacccgagaccacggctgttgtattcgtgtgcgngacgccgctaacggtcgggggcccggagtcccgttggtcc

SEQ ID NO: 360358 - DNA, 608 bp, Homo sapiens
  misc_feature: GZ8MTXP01A1IH2.2.16.B05.1.454.CMB.2.raw
  modified_base (306)..(306): a, c, t, g, unknown or other
  misc_feature (306)..(306): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggagtttggtccagccgtggggggtccctgagactctcgtgtgcggcctctggattcatctctacaaactattggatgagctgggtccgtnaggctccgaggggaggggctgggaggtgggtgccagcagtcggaacggagagtagggaaagtaacaaaaagaactagtggtaggactcgtggtaggaaaggggccctattccaacctatcctaccgaagacgaaccaaccgaccaaagaactcaactggtaatcgtagactaaagtcgaaaccacgaccctaaacgaccccggaaggaccacgggtcttggttagttaacttaccgtggtcgacgagaccggaaccgcgttaaccgggcgggggccccgggagtccccgttgggtaaccccg

SEQ ID NO: 360359 - DNA, 570 bp, Homo sapiens
  misc_feature: GZ8MTXP01CRIUI.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctgagactctcgtgtgcggcctctggattcatctctacaaactatggatgagctgggtccgtcaggctccgaggggaggggctgggagtggggtgccagcagtcggaacggagagtggaaagtaacaaaaagaactatgtagggactcgtgtagaacgggcctagttcaccatcctccagacgacaacgccaaagactcactggtaactctagacaaatcgaaacagaacctaacggaccccgaaggaccaacggctggttgttacttacgtgtgacgagacgaaccgcgtaacgggtcggggcccggagtccccgttgggtaaccc

SEQ ID NO: 360360 - DNA, 697 bp, Homo sapiens
  misc_feature: GZ8MTXP01D75A3.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggtaggtttggtccagccgtgggggtccctgagactctcgtgtgcggcctctggattcatctctaacaaactattggatgagcgtgggtcctcgaggcctcgaagggggaagggggcgtgggaggtggggtggccagcagtacggaacgggagagtaggaagtaaacaaaagaactagtggtagggactcgtggtagggaaacggggtccctaatttccgaacctattccgtacccgaaaggaacggaacccaaaccgggaccaaaaacggaaccttacaacctttggggttaaacttccgtagaactaaaattcggaaaacctacggaaaccccttaaaacgggacccccggaaagggtaacccgacgggtctttgggttacttaaacgtttacgtgggtagaccggttacggaaccgccccggtcgttaaccggggcggggggggacccccggagtccccccgggttgggttaacccccg

SEQ ID NO: 360361 - DNA, 572 bp, Homo sapiens
  misc_feature: GZ8MTXP01BFM6L.2.16.B05.1.454.CMB.2.raw
  modified_base (515)..(515): a, c, t, g, unknown or other
  misc_feature (515)..(515): n is a, c, g, or t
  modified_base (533)..(533): a, c, t, g, unknown or other
  misc_feature (533)..(533): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgccatttagaaggtgtccagtgtgaggtgcagctggtggagtcgtgggggaggtttggtccaggccgtggggggtccctgagactctcgtgtgcggcctctggattcatctctacaaactattggatgagctgggtccgtcaggctccgaggggaggggctgggaggtgggtggccagcagtgaacggagataggaaagtaacaaaagaactagtgtggactcgtaggtgaaaggggcctaattccaaccatcctccaagagacaacgccaaagtaactcaactggtaatcgtagacaaaatgaaaccagaccctaaagcccgaaggaccagggctggttgtaattacgngtgacgagacggaacccncgtaacggtcggggggccccggagtccccgttgggtccc

SEQ ID NO: 360362 - DNA, 659 bp, Homo sapiens
  misc_feature: GZ8MTXP01CG5EE.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctgagactctcgtgtgcggcctctggattcatctctaacaaaactattggatggagcgtgggtccgtcaggctaccgagggggaaggggcgtgggaggtgggggtggccagcagtaggaacggagagtaggaaagtaaacgaaaaagaactaagtggtaggtactcgttagggtaggaaacgggggccctaatttaccaaccctattacccgtaccgaaagaacgaaacccaaaccggaccaaagaaacctcaaacgttggtaactccgtagaacctaaaagtcgaaacacggaaccctaaacggaccccggaaggaccgacgggtctggttagttaacttacgtggtcgaccggagaaccggccgtacgtaacggtccggggggaccccggttagtcccccggttggtaaccccg

SEQ ID NO: 360363 - DNA, 572 bp, Homo sapiens
  misc_feature: GZ8MTXP01CAO7T.2.16.B05.1.454.CMB.2.raw
  modified_base (488)..(488): a, c, t, g, unknown or other
  misc_feature (488)..(488): n is a, c, g, or t
  modified_base (506)..(506): a, c, t, g, unknown or other
  misc_feature (506)..(506): n is a, c, g, or t
  modified_base (536)..(536): a, c, t, g, unknown or other
  misc_feature (536)..(536): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctgggtggagtcgtgggggaggtttggtccagccgtggggggtccctgagactctcgtgtgcggctctggattcatctctacaaactattggatgagcgtgggtccgtcaggctccgaggggaggggctgggagtgggtgccagcagtcggaacggagagtagggaagtaacaaaagaactatggtagggactcgtggtaggaaggggccctaattccaaccattcctacccgaaaggacgaaccaaacggccaaagaacctcgacttggtatctagacaaatgaaacngacctaagacccgagacnggctgttgattcgtggtgcgagcgaaccgngtaacgcgggggcccggacgtcccgttgggtaaccc

SEQ ID NO: 360364 - DNA, 599 bp, Homo sapiens
  misc_feature: GZ8MTXP01A1FZ9.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgccattttagaaggtgtcagtgtgaggtgcagctggtggagtcgtgggggaggtttggtccaggccgtggggggtccctgagactctcgtgtgcggcctctggattcatctctacaaactattggatgagctgggtccgtcaggctccgaggggaaggggctgggaggtgggtggccagcagtcggaacggagagtggaagtaacaaaagaactatggtagggactcgtaggtaggaaacgggtcccgtaatttccgaacctacttcctacccgaaggaacgacaaaccgcccaaagaacctacactggtaatcgtagaacaaatcgaaacacgacctaaacggacccgaggacacgggcttgttagtacttacgtggtgcggagacgaacccgtcgtaacggtcgggggccccgggagtcccgttcggtcccg

SEQ ID NO: 360365 - DNA, 565 bp, Homo sapiens
  misc_feature: GZ8MTXP01C6DW0.2.16.B05.1.454.CMB.2.raw
  modified_base (501)..(501): a, c, t, g, unknown or other
  misc_feature (501)..(501): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctggtggagtcgtgggggaggtttggtccagccgtggggggtccctgagactctcgtgtgcggcctctggattcatctctacaaactattggatgagcgtgggtccgtcaggctccgaggggaggggctgggaggtgggtggccagcagtcggaacggagagtagggaaagtaacaaaaagaactagtggtagggactcgtggtaggaaacggggcccgtattccacatcctaccaagacgaacaacgccaaagactcactggtatctagacaaatgaacagacctaagacccgagaccncggctgttgtattcgtgtgcgagacgaaccgctaacggcgggggcccggacgcccgttggtccc

SEQ ID NO: 360366 - DNA, 675 bp, Homo sapiens
  misc_feature: GZ8MTXP01EVOXO.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgccattttagaaggtgtccagtgtgaggtgcagctggtggagtcgtgggggaggtttggtccagccgtggggggtccctgagactctcgtgtgcggcctctggattcatctctaacaaactattggatgagcgtgggtccgtcaggctccgagggggaaggggctgggaggtggggtggccagcagtcggaaacggagagtaggaaagtaaacaaaaagaactagtggtggactcgtaggtaggaaacgggggccctaatttcccaaccgtattccctaccgaaggaacgaaccaaaccggacccaaaagaaacctcaacgttgggtaacttccgtagaacctaaaagtcggaaaccaaggtaacccctaaagggaacccccggaaggaacccaacggggtcttaggttaggttaactttaccgtgggtacgaccggaggaaccggtaaccccggtgtaacccggggtcggggggacccccgggagtcccccggttggggtaaccccg

SEQ ID NO: 360367 - DNA, 552 bp, Homo sapiens
  misc_feature: GZ8MTXP01EAR74.2.16.B05.1.454.CMB.2.raw
  modified_base (328)..(328): a, c, t, g, unknown or other
  misc_feature (328)..(328): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
  modified_base (516)..(516): a, c, t, g, unknown or other
  misc_feature (516)..(516): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggagtttggtccaggccgtggggggtccctgagactctcgtgtgcggcctctggattcatctctacaaactattggatgagctgggtccgtcaggctccgaaggggaggggcngggaggtgggtgccagcagtcggaaacgggagagtggaaagtaacaaaaagaactatggtggactgtggtgaagggccattcacatcncaganacaacgccaaagactcaactggtatctagacaaatgaaacagaccctaagacccgaggtacacgggctgttgtattacgtgtgcgagacgcccgngtaacggtcgggggcccggagtccccgttgggtccc

SEQ ID NO: 360368 - DNA, 584 bp, Homo sapiens
  misc_feature: GZ8MTXP01DE8MC.2.16.B05.1.454.CMB.2.raw
  modified_base (541)..(541): a, c, t, g, unknown or other
  misc_feature (541)..(541): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctgagactctcgtgtgcggcctctggattcatctctacaaactattggatggagcgtgggtccgtcaggctccgagggggaagggggctgggaggtggggtggccagcagtcggaacggagagtaggaaagtaacaaaagaactatggtaggactgtgtggaaggggccattcaccatctaccaagacaacaacgccaaagaactcactggtaactctagacaaatgaaacagacctaaggacccgaaggaccaacgggtctgttacgttattacgtggtcgacgagacggaacccgnttaaccgggcgggggacccgggacgtccccgttgggtaacccc

SEQ ID NO: 360369 - DNA, 702 bp, Homo sapiens
  misc_feature: GZ8MTXP01CG6TY.2.16.B05.1.454.CMB.2.raw
  modified_base (618)..(618): a, c, t, g, unknown or other
  misc_feature (618)..(618): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagcgtgggtggagtcgtgggggtaggtttggtccaggtcgtggggggtccctgagactctcgtgtgcggcctctggattcatctctaacaaactattggatggagtcgtgggtcccgtcgaggccgtaccggaagggggacgggggcgtggggaggtggggtcggccaggcagtacggaacgggagagtaggaaagtaaacaaaagtaactagtggtaggtactcgtaggtagggaaacggggtccctaattacccaaccgtacttccctaccgaagaacgaaccaaaccgacccaaagtaacctcgaaccgttaggttaacttaccgtttaacaaaagttcggaaaaccacggtaaccccgtaaaacgggaccccggaacgggaacctaccggggtctaagggttcgttaaattccgngggtacgacggttacggcgaccccggtctaacggggtccggggggaccccggtaggttccccgttcgggaacccttaaccccgg

SEQ ID NO: 360370 - DNA, 597 bp, Homo sapiens
  misc_feature: GZ8MTXP01DG54V.2.16.B05.1.454.CMB.2.raw
  modified_base (550)..(550): a, c, t, g, unknown or other
  misc_feature (550)..(550): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctgagactctcgtgtgcggcctctggattcatctctacaaactattggatgagcgtgggtccgtcaggctccgaggggagggctgggagtgggtgccagcagtcggaacggagagtaggaaagtaaacaaaagaactagtggtaggactcgtggtaggaacgggtcccttagttaccaaccgtatcctacccgaagacgaaccaaaccgaccaaagaactacaacttggtactctagacaaatcgaaacacgaacctaaacggaccccgaaggaccaacggtctagttagttattacgtggtgacgngacgccgacgtaacggtcggggcccggacgtcccgttgggtaacccg

SEQ ID NO: 360371 - DNA, 625 bp, Homo sapiens
  misc_feature: GZ8MTXP01BP7HL.2.16.B05.1.454.CMB.2.raw
  modified_base (271)..(271): a, c, t, g, unknown or other
  misc_feature (271)..(271): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctgggtggagtcgtgggggtaggtttggtccaggccgtgggggtcgtccctgagactctcgtgtgcgctntggatcatctactaacaaactatgatgagcgtgggtccgtcgaggctacggagggggacggggcgtgggaggtgggtcgccagcagtaggaacggagagtaggaaaacgtaacaaagactagtgtaggactcgtggtaggaacgggctattcacctatcctaccgaagacgaacgaaccgaccaaagaacctcacgttagtactacctagaacctaaagtacgaaacgacgaacccgtaaacggaccccggaggaaccaacgggtcttaggtacgttacttacggtgttacggcgaaggtaaccggaccgtcgtaccggggtcgggggaccccggtaacgttcccgtaaccggg

SEQ ID NO: 360372 - DNA, 675 bp, Homo sapiens
  misc_feature: GZ8MTXP01AFHWY.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctggtggagtcgtgggggtaggtttggtccaggccgtggggggtccctgagactctcgtgtgcggcctcgtggattcatctactaactaaactattggatggagcgtggggtcccgtcgaggcctccggaagggggaggggtcgtggggaggtgggggtcggccaggcagtcggaaacggagagtagggaagtaaacaaaagaactagtgggtaggactcgtggtagaaacggggccctattccaacctatccctacaaggacgaaccaaaccggaccaaagaaacctcaacgttaggtaactccgtagaacctaaaagtcgaaaaccgacggaaccccgtaaacggaacccccggtaagggacccacggggtcttaggttcgttaaattaccgtggtacggccggaagaccggaaccccggtcgttaacccggggcgggggacccccggggatccccccgttggggtaacccc

SEQ ID NO: 360373 - DNA, 622 bp, Homo sapiens
  misc_feature: GZ8MTXP01A1VNQ.2.16.B05.1.454.CMB.2.raw
  modified_base (272)..(272): a, c, t, g, unknown or other
  misc_feature (272)..(272): n is a, c, g, or t
  modified_base (383)..(383): a, c, t, g, unknown or other
  misc_feature (383)..(383): n is a, c, g, or t
  modified_base (567)..(567): a, c, t, g, unknown or other
  misc_feature (567)..(567): n is a, c, g, or t
  modified_base (616)..(616): a, c, t, g, unknown or other
  misc_feature (616)..(616): n is a, c, g, or t
  modified_base (618)..(619): a, c, t, g, unknown or other
  misc_feature (618)..(619): n is a, c, g, or t
  modified_base (621)..(622): a, c, t, g, unknown or other
  misc_feature (621)..(622): n is a, c, g, or t
tcagacgctcgacacacgaccggtgctcgatttagagctcacgtattgggtctgggggaggtttggtccagcctggggggtccctgagactctcgtgtgcggcctctggattcatctctacaaactattggatgagctgggtccgtcaggctccgagggaaggggctggagtgggtggccagcatgaacggagatggaagtcaaaagaactatgtggactctgtgaaggccattcaccatctcagagacaacgccaaagactcactgtatcngacaaatgaaacagacctaaagaccccgaggacacggctgtgtattacgtgtgcgagacgaccgctacggcgggggcccggacgccccgtggtcccacccgttctccctcncgcccctacccgaacccgaacggggccccctaagttccccggttcccttccccccgtcggcccgtccccgtcgcccgtacccgacgggacgcccacccgtaccgacgacgaccgaccgacggggcccggtcccgtcgggccgtcgccgtcggtaccgaacggtccttaccgttccgtcgtccgngtccgttcgtggacggtcgggcgttcgggccgacgggccgcgtaagtgngnngnn

SEQ ID NO: 360374 - DNA, 559 bp, Homo sapiens
  misc_feature: GZ8MTXP01EABIM.2.16.B05.1.454.CMB.2.raw
  modified_base (500)..(500): a, c, t, g, unknown or other
  misc_feature (500)..(500): n is a, c, g, or t
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
  modified_base (530)..(530): a, c, t, g, unknown or other
  misc_feature (530)..(530): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggtaggtttggtccagccgtgggggtccctgagctctcgtgtgcgcctctggattcatctctacaaactattggatgagctgggtcccgtcaggctccgaggggaaggggctgggagtggggtgccagcatcggaaacggagagtaggaaagtaacaaaaagaacttagtggtagggactgtggtaggaacgggcccgattccaccagtcctaccaagacaaccaacgccaaagaactacgactggtatcgtagaccaaatgaaacagacctaagacccgagacnggctgttctattcgngtgcgngacgcccgntcggcggggcccggagtcccgttggtccc

SEQ ID NO: 360375 - DNA, 522 bp, Homo sapiens
  misc_feature: GZ8MTXP01A08SA.2.16.B05.1.454.CMB.2.raw
  modified_base (344)..(344): a, c, t, g, unknown or other
  misc_feature (344)..(344): n is a, c, g, or t
  modified_base (374)..(374): a, c, t, g, unknown or other
  misc_feature (374)..(374): n is a, c, g, or t
  modified_base (392)..(392): a, c, t, g, unknown or other
  misc_feature (392)..(392): n is a, c, g, or t
  modified_base (418)..(418): a, c, t, g, unknown or other
  misc_feature (418)..(418): n is a, c, g, or t
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggtttcctgttgccattttagaggtgtccagtgtgaggtgcagctggtggagtcgtgggggagtttggtccagccgtggggggtccctgagactctcgtgtgcggcctctggattcatctctacaaactattggatgagctgggtcctcaggctccgagggagggctgggagtgggtgcagcatgaacggngagtagaagtaacaaaagctatgtggactntgtgaaggcatcacatcncagagacaacgcaagactcactgtanctagacaaatcgaacagacctaagacccgaggaccacggctgagtattacgngtgcgagngaacccgtctaacggtcgggggcccgacgtcccgttggtaaccc

SEQ ID NO: 360376 - DNA, 592 bp, Homo sapiens
  misc_feature: GZ8MTXP01EGJDE.2.16.B05.1.454.CMB.2.raw
  modified_base (512)..(512): a, c, t, g, unknown or other
  misc_feature (512)..(512): n is a, c, g, or t
  modified_base (519)..(519): a, c, t, g, unknown or other
  misc_feature (519)..(519): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggagtttggtccagccgtggggggtccctgagactctcgtgtgcggcctctggattcatctctaacaaactattggatgagctgggtcctcaggctccgaggggaggggctgggagtggggtgccagcagtgaacggagagtaggaaagtaacaaaaagaactagtgtgggaacttcgtaggtaggaaacggggccctattccaacattccaccaaggacgaaccaacgacaaacgaactacactgggtaactcttagacaaatcgaactacgaccgtaaacggaccccgaggaccnccgggtntgttgttattacgtgcgacggagacggcccgcgttaacggccgggggacccggagtcccccgttgggtccccc

SEQ ID NO: 360377 - DNA, 650 bp, Homo sapiens
  misc_feature: GZ8MTXP01BQ8I7.2.16.B05.1.454.CMB.2.raw
  modified_base (512)..(512): a, c, t, g, unknown or other
  misc_feature (512)..(512): n is a, c, g, or t
  modified_base (519)..(519): a, c, t, g, unknown or other
  misc_feature (519)..(519): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcgtggtttctgtgccatttagaaggtgtcagtgtgaggtgcagctggtggagtcgtgggggtagtttggtccaggccgtgggggtccctgagctctcgtgtgcgcctctggattcatctactaacaaactattggatgagcgtcgggtccgtcgaggtcctaccggaagggggagggggcgtgggggaggttgggggtcggccgaggcgaagtacggaaacgggagagtagggaaagtaaacgaaaaagtaacttaagtggtagggtacctgttagggtaggaaacggggcctattacccaacattccacaaggacgaaaccaaccggacaaaagacctacaccgttaggtaatccgtaaanaacaaanaagaacgacgaaccgaaccgaaccgaacggacgacgtaacgtcgttagtacgttacgtagtcgacggacggacggtaaccggtaccggtaaccgggtccggggacccgggaccggtcccggttccggtccg

SEQ ID NO: 360378 - DNA, 587 bp, Homo sapiens
  misc_feature: GZ8MTXP01EOPCS.2.16.B05.1.454.CMB.2.raw
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (553)..(553): a, c, t, g, unknown or other
  misc_feature (553)..(553): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcattttagaaggtgtccagtgtgaggtgcagctgggtggagtcgtgggggtaggtttggccaggccgtggggggtccctgagactctcgtgtgcggcctctggattcatctactaacaaactattggatgagtcgtggggtccgtcgaggctaccgaagggggaagggggctgggaggtgggggtggccagcagtaggaacggagagtagggaaagtaaacgaaaaagtaactagtggtagggactcgtagggtaggaaacggggtccctaagttccaaccatcctaccaagacgaacaacgccaaagactacacttggtaatctagacaaatgaaacagaccgtaacgacccgaggaccacggtctgttagtattagngngacgngacgccgcgtcggcggggcccgcgtccgttgtcc

SEQ ID NO: 360379 - DNA, 648 bp, Homo sapiens
  misc_feature: GZ8MTXP01B187Q.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctgggtggagtcgtgggggaggtttggtccaggccgtggggggtccctgagactctcgtgtgcggcctctggattcatctctaacaaactattggatggagtcgtgggtccgtcgaggctccggaagggggagggggctagggaggtggggtggccagcagtacggaacggagagtaggaaagtaaacaaaagtaactagtaggtagggactcgtagggtagggaaacggggtccctaattcccaaccgtattccgtacccgaaggaacgaaaccaaaccggaccaaaagaaccctcaacgttaggggtactcgtagaacctaaaatcgaaacacgaacccgtaaacggaccccggaaggaccacgggtctggttagttacttacgtggtcgttacgaggacgccgtcgtaacggtcgggggccccggatccccggttaaggtcccc

SEQ ID NO: 360380 - DNA, 608 bp, Homo sapiens
  misc_feature: GZ8MTXP01AGIVR.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctgggtggagtcgtgggggaggtttggtccagccgtggggggtccctgagactctcgtgtgcggcctctggattcatctctacaaactattggatgagctgggtccgtcaggctcgagggagggctgggagtggggtgccagcagtacggaacggagagtaggaagtaaacaaaagaactagtggtaggactcgtggtaggaacgggcccgtaattccgaaccatcctaccgaagacgaacaacggaccaaagaactacacgtggtaatcgtagaaccaaaatcgaaacacgacccgtaaacggaccccggaagggaaccacgggtcttggttaggttaacttacgtggtacgcggagacgaacccgcgtaaccggtcgggggccccggagtccccgttggtaaccccg

SEQ ID NO: 360381 - DNA, 535 bp, Homo sapiens
  misc_feature: GZ8MTXP01CPSQV.2.16.B05.1.454.CMB.2.raw
  modified_base (282)..(282): a, c, t, g, unknown or other
  misc_feature (282)..(282): n is a, c, g, or t
  modified_base (415)..(415): a, c, t, g, unknown or other
  misc_feature (415)..(415): n is a, c, g, or t
  modified_base (438)..(438): a, c, t, g, unknown or other
  misc_feature (438)..(438): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
  modified_base (500)..(500): a, c, t, g, unknown or other
  misc_feature (500)..(500): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcgtggtttcgtgtagccatttagaaggtgtcagtgtgagtgcagctggtggagtgtgggggaggtttggtccaggccgtggggggtccctgagctctcgtgtgcggcctctggattcatctctaacaaactnttggatgagctgggtcctcaggctcgagggggagggctgggagtggggtgccaggcatcggaaagggagagtaggaaagtaacaaaaaggaactagtggtggactcgtagtggaagggcctatcaccattccncgaagacactaacgcaaagactnaacttggtatgcgaanaanagacacgacgacgacgacgacgcgcgtgttgtagttgtgtcgngcgacgcgcgtcggcgggccggcgtccgttcgtcg

SEQ ID NO: 360382 - DNA, 680 bp, Homo sapiens
  misc_feature: GZ8MTXP01D9BL9.2.16.B05.1.454.CMB.2.raw
  modified_base (288)..(288): a, c, t, g, unknown or other
  misc_feature (288)..(288): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaagtgtccagtgtgaggtgcagctggtggagtcgtgggggtagtttggccagccgtggggtctccctgagctctcgtgtgcggcctcgtggattcatctctaacaaactnttggatgagcgtcgggtcctcgaggcctaccggagggggaggggtcgtgggaggtggggtcgccagcaagtaggaaacggagagtagggaaaaagttaacaaagtaactagtaggtacggacttcgtagggtagggaaacgggtcctaagttaccaacctagttacccgtacccgaaggaacgaaaccgaaacccgcccaaaaggtaacccttcaaacgttgttaactacgtacgaaactaaaacgtcgaaaaccgtacgaacccgtaaacggaccccggaggaaccgtaacgggtctttagggttacttaagtttaccggtggttacggacgaacgggaaccgcccggtcgttacggggccggggggacccgggtccgttccccggttcgg

SEQ ID NO: 360383 - DNA, 526 bp, Homo sapiens
  misc_feature: GZ8MTXP01BCLEQ.2.16.B05.1.454.CMB.2.raw
  modified_base (441)..(441): a, c, t, g, unknown or other
  misc_feature (441)..(441): n is a, c, g, or t
  modified_base (468)..(468): a, c, t, g, unknown or other
  misc_feature (468)..(468): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
  modified_base (497)..(497): a, c, t, g, unknown or other
  misc_feature (497)..(497): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtgggggtccctgagactctcgtgtgcggcctctggattcatctctacaaactattggatgagctgggtccgtcaggctccgagggaggggctgggagtgggtgccagcagtgaacggagatggaagtacaaaagaactatgtggactcgtgtgaagggccattcacatcctcagagacacgcaaagactcactggtatctagacaaangaacagacctaagacccgagacacggntgttgtattacgngtgcgngacgaaccgntaacgcgggggcccgagcccgttggtccc

SEQ ID NO: 360384 - DNA, 669 bp, Homo sapiens
  misc_feature: GZ8MTXP01BRJES.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctgggtggagtcgtgggggaggtttggtccaggccgtggggggtccctgagactctcgtgtgcgcctctggattcatctctaacaaactattggatgagcgtgggtccgtcaggctccgaggggaagggggctgggaggtggggtggccagcagtacggaacggagagtaggaaagtaaacaaaagaactagtggtaggactcgtggtaggaaacggggcccgtaatttccaacctagttccctacccgaaaggacgaaccaaaccggacccaaaagaacctcaaccttggggttaactcgtagaaccaaaagtacgaaaccgacgtaacccgtaaacggaccccggaaggaccgaaccggggtcttaggttacgttacgttacggtggtacggacggacggaccggtaacccggtacggtaaccggggtccggggggaacccgggttccggtccccggttcgggtcccg

SEQ ID NO: 360385 - DNA, 685 bp, Homo sapiens
  misc_feature: GZ8MTXP01AC3W6.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctgggtggagtcgtgggggtaggtttggtccaggccgtggggggtccctgagactctcgtgtgcggcctctggtattcatctactaactaaactattggatggagcgtgggtcccgtcaggctccggaaggggaggggctgggaggtgggggtggccagcagtacggaacggagagtaggaaagtaaacaaaaagtctagtggtaggtactcgtaggtaggaaacggggtcctaagttccaaccgtataccgtacccgaaaggaaccgaaccaaaccggacccaaagtaaacccttcgaaccgttgttaactcgtacgaaccgtaaaaatcgaaaaccgacgtaacccctaaacggaccccgaaaggaccccgaacgggtctggtttacggttaacgttacgtagggtacgggacgaaaggaccggaaccggtccgttaaccggggtcggggggacccccgggagtccccggttggtaaccccg

SEQ ID NO: 360386 - DNA, 649 bp, Homo sapiens
  misc_feature: GZ8MTXP01A123X.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagcgtgggtggagttcggtggggggtaggtttcggtccaggccggtcggggggtccctgagactcgtcgtgtgccggcctctggattcatctctaacaaactagttggatgagcgtgggtcccgtcgaggctaccggagggggagggggcgtgggaggtgggggtcggccaggcagtcggaaacgggagagtaggaaagtaaacaaaaagaactagtggtaggacttcgtgggtacggaaggggccctagttaccactatcctaccgaagacgaaccaaccgacaacgaaacctcaacgttgtactcgtagaactaaagacgaaaccgacgtaacccggtaacgacccggaacggaccgacggtgtagttcgttaagttcgtggtacggacgacggaccgaacccggtcgtaacggggccgggggaccccggaccgtcccggttcggtcccg

SEQ ID NO: 360387 - DNA, 575 bp, Homo sapiens
  misc_feature: GZ8MTXP01DJ9UP.2.16.B05.1.454.CMB.2.raw
  modified_base (179)..(179): a, c, t, g, unknown or other
  misc_feature (179)..(179): n is a, c, g, or t
  modified_base (312)..(312): a, c, t, g, unknown or other
  misc_feature (312)..(312): n is a, c, g, or t
  modified_base (335)..(335): a, c, t, g, unknown or other
  misc_feature (335)..(335): n is a, c, g, or t
  modified_base (464)..(464): a, c, t, g, unknown or other
  misc_feature (464)..(464): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcgtggtttctgtagccattttagaaggtntcagtgtgaggtgcagctggtggagtcggtgggggtagtttggtccaggccgttggggggtccctggagtctcgtcgtgtcgcggcctctggattcatctactaactaaactatggatgagcgtgggtccgtnacggcctacggaggggacggggngtgggaggtgggggtgccagcagtaggacggagagtaggaagtaaaccaaaagaacttgtagtagaccttgtgtagggaaacgggtcattacacatcctacgaaagacgaacaacgaccaaatacctanactaggtacttcagacaaagagaacacgacgaacgaccgacgacgacgcgtgttagtacgttacgtgtgcgcgacgcgcgtcggtacgggccgggccgtccgttcgtcccg

SEQ ID NO: 360388 - DNA, 636 bp, Homo sapiens
  misc_feature: GZ8MTXP01CDS9C.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggagtttggtccagccgtggggggtccctgagactctcgtgtgcggcctctggattcatctactaacaaactattggatgagtcgtgggtccgtcgaggcctaccgagggggaaggggctagggaggtggggtcgccagcagtacggaacggagagtaggaaagtaaacaaaaagtaactagtaggtaggactcgtaggtaggaaacggggcccgtattccaacctatcctaccgaagaacgaaccaaaccgacccaaagaacctcaacttagggtaacttcctagaacaaaagtcgaaacacgtaacccgaaagaaccccggaaggaccaacgggtcttagttagttacttacgtggtcgacggagacggtcccgacgtaaccggtcgggggaccccggacgtccccgttggtaaccccg

SEQ ID NO: 360389 - DNA, 623 bp, Homo sapiens
  misc_feature: GZ8MTXP01B6R2N.2.16.B05.1.454.CMB.2.raw
  modified_base (580)..(580): a, c, t, g, unknown or other
  misc_feature (580)..(580): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtcagtgtgaggtgcagcgtggtggagtcggtggggggtaggtttggtccgaggtccggtggggggtccctgagacttcgtcgtgtcggcggcctcgtggtattcatctactaacaaactattggatgagtcgtcgggtccgtcgaggctaccggaagggggaggggcgtgggaggtggggtcggccagcagtacggaacggagagtaggaaagtaaacgaaaaaagtaacgtagtggtaggtacctgtggtagggaaacgggcgtaattccacgtatcctacaacggacgaacaaaccgaccaaagaactcaactggtatcgtagaactaaatagaaacacgaacccgtaaacgacccggacgaaccgacggtctagttcgtattacgtgtgacgngacgaacgcgtcggcgggggcccgacggtcccgttcggtcccg

SEQ ID NO: 360390 - DNA, 611 bp, Homo sapiens
  misc_feature: GZ8MTXP01AQFJB.2.16.B05.1.454.CMB.2.raw
  modified_base (358)..(358): a, c, t, g, unknown or other
  misc_feature (358)..(358): n is a, c, g, or t
  modified_base (593)..(593): a, c, t, g, unknown or other
  misc_feature (593)..(593): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccaggccgtggggggtccctggagactctcgtgtgcggcctctggattcatctactacaaactattggatgagctgggtccgtcaggctccgaggggaggggctgggaggtgggtgccagcagtcgaacggngagtggaaagtaacaaaaggaactatggtggacttcgtgtagaaacggggcctaattccaaccacttccacccgaagacgaaccaaacggaccaaaagaacctcaacttaggtaatcgtagacaaaatgaaaccacggtacctaaacggccccgaagggaaccgtacggcgtgttgttaacttacgtgggtagccggagacggaaccccgtgtaaccggtcggggggccccgggngtccccgttggggtcccc

SEQ ID NO: 360391 - DNA, 657 bp, Homo sapiens
  misc_feature: GZ8MTXP01BI1TU.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctggtggagtcgtgggggtaggtttggtccagccgtggggggtccctgagactctcgtgtgcggcctctggattcatctactacaaactattggatgagcgtgggtcccgtcgaggctccggaagggggaaggggcgtgggaggtggggtggccagcagtacggaacggagagtaggaaagtaacaaaagtaactagtgtaggactcgtgggtaggaaacgggccgtattccaaccgtatcctacaaggaacgaccaaaccggaccaaagaacctacacgtaggtactctagaccaaagtcgaaactacgaccctaaacggaccccggaggaaccgacgggtctgttacgttaaacgttcgtgggtgaccggaggaaccggaaccccgggtacgtaacccggggttccggggggggacccccggggttacggtcccccggttggggtaaccccccg

SEQ ID NO: 360392 - DNA, 612 bp, Homo sapiens
  misc_feature: GZ8MTXP01CR4TG.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctggtggagtcgtgggggtaggtttggtccgagccgtggggggtccctgagactctcgtgtgcgcctctggattcatctctaacaaactattggatgagtcgtgggtccgtcgaggcctaccggaagggggaagggggcgtgggaggtgggggtggccagcagtacggaacggagagtaggaagtaaacaaaaagaactagtggtaggactcgtggtaggaacgggcctattccaacctatcctaccaagacgaacaaccgacaaagactcactggtactctagacaaatgaaacagacccgtaaacgacccgaggaccgacggtcttaggttagttacttcgtaggtcgacggttagaccggaacccgcgtaaccgggtcgggggacccggacgtcccgttggtaaccccg

SEQ ID NO: 360393 - DNA, 651 bp, Homo sapiens
  misc_feature: GZ8MTXP01EN7AH.2.16.B05.1.454.CMB.2.raw
  modified_base (497)..(497): a, c, t, g, unknown or other
  misc_feature (497)..(497): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggtttcctgttgccattttagagtgtccagtgtgaggtgcagctggtggagtcgtgggggaggtttggtccagccgtggggggtccctgagactctcgtgtgcggcctctggattcatctactacaaactattggatgagcgtgggtccgtcaggctccgagggggaggggctgggaggtggggtggccagcagtcggaacggagagtaggaagtaaacaaaagtaactagtggtaggacttcgtaggtagggaacgggccctattaccgaacctattccctacgaaaggacgaaaccaaccggaccaaaaggtaacctacctaacgttagggtacttcggtanaaccaaagtcgaaacctacgaacccgtaaacggaccccggagaccgaacgggtcttagttagttacgtttacgtggtacggaccggttagaccggtaacccgtcgtaaccgggtccggggggaccccggttacgtccccgttggggtaaccccg

SEQ ID NO: 360394 - DNA, 647 bp, Homo sapiens
  misc_feature: GZ8MTXP01ATTPY.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggtaggtttggtccaggccgtggggggtccctgagactctcgtgtgcggcctcgtggatcatctctaacaaactattggatgagcgtcgggtcctcgaggctccggagggggaagggggcgtgggaggtggggtggccaggcagtacggaacggagagtaggaagtaaacaaaagaactagtggtaggactcgtggtaggaacgggccgtattaccgactactcctaccgaagacgaaccaacgaccaaagaactctacgtgtactcgtacgaactaaagtcgaaacgacgtaaacccgaaaccggaaccccggaaggaaccgacggggtcttaggttagttaaacttacggtggtcggacggaacggacggaaccccgtccggtaacggggtcccggggggccccggacggtccccgttcgggtaaccccg

SEQ ID NO: 360395 - DNA, 631 bp, Homo sapiens
  misc_feature: GZ8MTXP01B6QJM.2.16.B05.1.454.CMB.2.raw
  modified_base (286)..(286): a, c, t, g, unknown or other
  misc_feature (286)..(286): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctggtggagtcgtgggggtaggtttggtccagccgtgggggtccctgagctctcgtgtgcgctctggattcatctctaacaaactnttggatgagtcgtgggtccgtcgaggctaccgagggggaaggggcgtgggaggttgggggtcggccaggcagtcggaaacggagagtaggaaagtaaacaaaagaactagtgtggactcgtaggtggaaacggggtcctattaccacctatcctaccgaaggacgaacaaaccgaccaaagaacctacacttaggtactcgtagactaaaatcgaaaccagaccctaaaggacccggaagaccgagggtcttaggttgttaacttacgtggtacggccggttaagaccggaacccgtcggttaacgggccggggggaccccggacgtccccgttgggtaaccccg

SEQ ID NO: 360396 - DNA, 664 bp, Homo sapiens
  misc_feature: GZ8MTXP01CAN0N.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctggtggagtcgtgggggtagtttggtccaggccgtggggggtccctgagactctcgtgtgcggcctctggattcatctctaacaaactattggatgagtcgtgggtcccgtcgaggctccggaagggggaaggggctgggaggtgggtggccagcagtcggaaacggagagtagggaaagtaaacaaaaagtaactagtaggtgggtactcgtagggtacggaaacgggggtccctaattaccgaacctatacctacccgaaaggaacgaaccaaaccgaccaaagaacctcaacgttggtaacttctacgactaaaacgtcgaaacgtacgaacccgtaaacggaccccggaaggaccgaacggtcttaggttgtttaacttacgtggttcgacggagttacggaaccccggtcgtaaccggggtccgggggcccggttacgtccccgttcgggtaaccccg

SEQ ID NO: 360397 - DNA, 668 bp, Homo sapiens
  misc_feature: GZ8MTXP01DOFV0.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagcgtgggtggagtcggtgggggtaggtttggccaggccgtgggggtccctgagactctcgtgtgcggcctcgtggattcatctactaactaaactagttggatgagtcgtgggtccgtcgaggcctaccggaagggggaagggggcgtagggaggtgggggtcggccgagcgagtacggaacggagagtaggaagtaaacaaaagtaactagtggtaggtactcgtagggtagggaaacgggccgtaattcccgaactactacctacgaagaacgaaccaaacgaccgaaagaactacaacgttaggtactcgtagaactaaagtcgaaacacgaacccgtaaacggaacccgaaggaacccgagggtcttaggttagttaaacttacgtggtacgacgaacggaccgtaacccggtacggtaaccgggtccgggggaccccggttacgtccccggttgggtaacccc

SEQ ID NO: 360398 - DNA, 540 bp, Homo sapiens
  misc_feature: GZ8MTXP01EW2VX.2.16.B05.1.454.CMB.2.raw
  modified_base (188)..(188): a, c, t, g, unknown or other
  misc_feature (188)..(188): n is a, c, g, or t
  modified_base (205)..(205): a, c, t, g, unknown or other
  misc_feature (205)..(205): n is a, c, g, or t
  modified_base (309)..(309): a, c, t, g, unknown or other
  misc_feature (309)..(309): n is a, c, g, or t
  modified_base (379)..(379): a, c, t, g, unknown or other
  misc_feature (379)..(379): n is a, c, g, or t
  modified_base (386)..(386): a, c, t, g, unknown or other
  misc_feature (386)..(386): n is a, c, g, or t
  modified_base (402)..(402): a, c, t, g, unknown or other
  misc_feature (402)..(402): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagngtgaggtgcagctgggngagtctgggggaggtttggtccaggccgtggggggtccctgagactctcgtgtgcggcctctggattcatctctaacaaactattggatgagcgtgggtccgtnaggctcccaggggaagggggctgggagtggggtggccagcatgaacggagatggaatacaaaagaactangtgactntgtgaaggcatcacanctcagagacaacgacaagaactcactggatcgtagacaaatgaacacgacctaaacgacccgaggacgacggctgttcgtattacgtggtcgagagaaccgcgtaacgtcggggcccgggacgtcccgttcgggtccg

SEQ ID NO: 360399 - DNA, 687 bp, Homo sapiens
  misc_feature: GZ8MTXP01AR626.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgcctattttagaaggtgtccagtgtgaggtgcagcgtgggtggagtcggtgggggtaggtttggccaggccgtgggggtccctgagctctcgtgtgcggcctcgtggattcatctactaactaaactattggatgagtcgtcgggtccgtcgaggctaccggaagggggacgggggcgtagggaggtgggggtcggccaggcagtacggaaacggagaagtaggaaagtaaacaaaaagaactagtaggtacggactcgtaggtacgggaaacgggtccctattccgaacctattccgaccgaagacgaaccaacgaccaaagtaacctcaacgttggtaactcgtaagaacaaaagtacgaaaccgacgtaacccgtaaacggaccccgggaaaggacccgacgggtcttaaggttagttaacctttaagtcggtaggaccggttaaacggaccggtaaccccggtcgttaaccggggcccggggggccccggactccccgggttaacggtaaccccg

SEQ ID NO: 360400 - DNA, 615 bp, Homo sapiens
  misc_feature: GZ8MTXP01DSLCM.2.16.B05.1.454.CMB.2.raw
  modified_base (534)..(534): a, c, t, g, unknown or other
  misc_feature (534)..(534): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgccattttagaaggtgtccagtgtgaggtgcagctggtggagtcgtgggggtaggtttggtccaggccgtggggggtccctgagactctcgtgtgcggcctctggattcatctactaactaaactattggatgagcgtgggtccgtcgaggcctaccggaagggggaggggctgggaggtgggtcgccagcagtcggaacggagagtagggaaagtaaacgaaaagtaacgtaatggtacggacttcgtaggtaggaaacgggcctaattcactatctaccaagacacaacgaccaaagactcacttaggtactctagactaaatcgaacacgtaacccgtaaacgacccggaggaaccgacgggtnttggttagttaattcgtaggtggacgttaggaaccgccggtcttaaccgggcggggggccccggactccccggttggtccc

SEQ ID NO: 360401 - DNA, 649 bp, Homo sapiens
  misc_feature: GZ8MTXP01AF3IN.2.16.B05.1.454.CMB.2.raw
  modified_base (603)..(603): a, c, t, g, unknown or other
  misc_feature (603)..(603): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgccattttagaaggtgtccagtgtgaggtgcagcgtggtggagtcgtgggggtaggtttggtccagccgtggggggtccctgagactctcgtgtgcggcctcgtggattcatctactaacaaactagttggatgagcgtgggtccgtcgaggctccgagggggaggggcgtgggaggtgggggtgccgagcgagtacggaacggagagtaggaaagtaaacaaaaagaactagtggtaggtactcgtggtagaacggggtcctaattccaccgatccacaagacaaaccgaccgaccaaagtacctacaacgtggtaactcgtagaactaaaagtcgaaaccgagtaaccccgtaaaaggacccccggtaaggacccgtacggggtcttaggttagttaacttaccgtgggacgttacggacgacggtaaccccgngttaacccgggcggggggcccccggttatccccggttcggtccccg

SEQ ID NO: 360402 - DNA, 797 bp, Homo sapiens
  misc_feature: GZ8MTXP01BC19G.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcgtggtttctgtgccatttagaggtgtcagtgtgaggtgcagctggtggagtcgtgggggagtttggtccagccgtgggggtccctgagactctcgtgtgcggcctcgtggattcatctactaacaaactattggaataaggcgttagggtccgtcgaggctaccggaagggggaaggggctggggaggttggggtacgggccagcgagtacggaaaccggagagtaggaaagtaacgaaaaaaaaggaactgtaggtagggaacttcgtaggtagggaaacggggtccctatttaccgaacctaattccctaccgaaagggtaaacccaaaccgaaaacccgggtaccccaaaaaggaaaccctttcccgaaactttaggttaacgttaccccgttaaaggaaaccctaaaaaatttcggggaaaaacccctaaccggtaaccccgtaaaaaacccgggacccccgggtaaaggggtaacccccaaacgggggtttacgtttaacgggttaagtttaaaccgtttacgggttacggtaccggaacgggttaaacggttacccgggttaccccggtaacgggtaccggggtcccggggggtaaccccggtaccgttccccggttaaccggttaaccccgtaacccgg

SEQ ID NO: 360403 - DNA, 653 bp, Homo sapiens
  misc_feature: GZ8MTXP01EO1Q1.2.16.B05.1.454.CMB.2.raw
  modified_base (601)..(601): a, c, t, g, unknown or other
  misc_feature (601)..(601): n is a, c, g, or t
tcagacgctcgacacacgaccggtgctcgatttagagctcacgtattgggtttgaggtctcagagaggagccttagccctggactccaaggccttttccacttggtgatcagcactgagcacagaggactcaccatggaattggggctgagctgggttttccttgttgctattttagaaggtgtccagtgtgaggtgcagctgggtggagttcggtggggggtaggttttggtccaggccgtgggggagtccctgagacttctcggtgtgcggcctcgtggtattcatctactaacaaactattggatggagcgttcggggtccgtcgacggcctaccggaagggggaagggggcgtggggagggtgggggtcgccgagcaacgtaggaaacgggagagtaggaaaagttaaacgaaagaactaagtggtaggtactacggtggtagggaacggggcctaattaccaccgtatccgtaaccgaaggacaaccaacgaccaaagaacctcaacgttgtaacttcgagaacaaagtacgaaacaacgacctaaagggaccccgaagggaccaacgggtcttaggttagttagttacgtggcgngaaggaacgccggtgtacccggggcgggggccccggtaacgccccgttaagg

SEQ ID NO: 360404 - DNA, 693 bp, Homo sapiens
  misc_feature: GZ8MTXP01ALB9G.2.16.B05.1.454.CMB.2.raw
  modified_base (310)..(310): a, c, t, g, unknown or other
  misc_feature (310)..(310): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctggtggagtcgtgggggtagtttggtccaggccgtggggggtccctgagctctcgtgtgcgcctctggattcatctactaacaaactgttggatgagcgtgggtccgtnaggctccgagggggaggggctgggaggtggggtggccagcagtacggaaacggagagtagggaataaacaaaaagtaactagtggtacggtactcgtaggtacgggaaacggggcctaacttccgaacctatcctaccgaaggacgaaaccaaacgacccaaaagtaacctcgaaccttaggggtaactccgtagaactaaaacgtacgaaaccgacggaaccccgtaaaacggaccccgggaaggtaaccgtacgggtccttagggttacgttaaacgtttccggtggtaccggacgggaacgacccgggaaaccccgtccggttaaccggggcccgggggggtacccccggggacgttcccccggttcgggttaacccccg

SEQ ID NO: 360405 - DNA, 676 bp, Homo sapiens
  misc_feature: GZ8MTXP01B6Y5D.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgccattttagaaggtgtcagtgtgaggtgcagctggtggagtcgtgggggaggtttggtccaggccgtggggggtccctgagactctcgtgtgcggctctggattcatctctaacaaactattggatgagcgtgggtccgtcaggctaccgagggggaggggctgggaggtggggtgccagcagtacggaacggagagtaggaagtaaacaaaagaactagtgtaggactcgtggtaggaaacgggtcctattccaaccgtattcctacccgaaggaacggaaccaaaccggacccaaaaggtaaacccttacgaaaccgtttaggggtaaacttcgtacgaaacctaaaagtacgaaaacccgaggtaaaccccgtaaaacgggacccccggaaagggtaacccacgggtccgttaggttaggttaactttaccggtggtacggacggaacggttacggaacccgtcgtaacgggtccggggggacccggacgtccccgttgggtccccg

SEQ ID NO: 360406 - DNA, 639 bp, Homo sapiens
  misc_feature: GZ8MTXP01DHLWJ.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctgggtggagtcgtgggggagtttggtccagccgtggggggtccctgagactctcgtgtgcggcctctggattcatctctaacaaactattggatgagctgggtccgtcaggctccgaggggaaggggctgggagtggggtgccagcagtcggaacgggagagtaggaagtaacgaaaagtaactagtgggtaggactcgtaggtaggaaacgggtcccgtattaccgaccagttcctaccgaaggaacgaacaaaccggaccaaaagaacctacaactaggttaacttccgtagaccaaaagttcggaaaccacggtaacccgtaaacggaccccgggaaggacccaacggggtcttggttacgttaattacgtgtcgggacgagacggaacccgacgtaacgggtccgggggcccggacgtcccgttcgggtaaccc

SEQ ID NO: 360407 - DNA, 632 bp, Homo sapiens
  misc_feature: GZ8MTXP01CID9G.2.16.B05.1.454.CMB.2.raw
  modified_base (279)..(279): a, c, t, g, unknown or other
  misc_feature (279)..(279): n is a, c, g, or t
tcagacgctcgacacacgaccggtgctcgatttagagctcacgtattgggtttgaggtctcagagaggaaccttagccctggactccaaggcctttccacttggtgatcagcactgagcacagaggactcaccatggaattggggctgagctgggttttccttgttgccattttagaaggtgtccagtgtgaggtgcagctggtggagtcgtgggggtaggtttggtcagccgtggggggtccctgagactcgtcgtgtgcggcctcgtggattcatcnctaacaaactattggatgagcgtgggtccgtcgacggctccggaagggggaacggggcgtgggaggtggggtcggccaggcagtcggaaccggagagtaggaagtacaaaaaaaagtactgtgtaggacttcgtgtaggaacgggccgtattccgaacctacgtcctaccgaaggaacgaacccgaaaccgacccgaaagtaacctacgacttgttaactcttaggaccaaagtcgaaacacgacctaaacggacccgaggacgacggtctaagtgttacgtacgttgtcggacgagccggacccgtcgtacggtccgggggccggtacgcccggtcggttcccgtaaccccg

SEQ ID NO: 360408 - DNA, 618 bp, Homo sapiens
  misc_feature: GZ8MTXP01A4SOZ.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccaggccgtggggggtccctgagactctcgtgtgcggcctcgtggattcatctctaacaaactattggatgagcgtgggtccgtcgaggctaccgagggaagaggctgggaggtgggtcggcctagcagtggaacggagagtaggaaaagtacaaaggtactagtggtaggactcgtaggtaggacgggacgtagttaccaaccgtactctaccgaagacaaccgaacgaccaaagaactcaacgtgtactctagactaaagcgaacacgaacctaacgacccggacggaccaacggtcttaggttagttaagttagtttaggcgttacgttaagtaaggtaattaaaacgttagtttaacggtttagtttttaagggaacggtttttaagg

SEQ ID NO: 360409 - DNA, 719 bp, Homo sapiens
  misc_feature: GZ8MTXP01A9JB2.2.16.B05.1.454.CMB.2.raw
  modified_base (301)..(301): a, c, t, g, unknown or other
  misc_feature (301)..(301): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctgggtggaggtcgtgggggtaggtttggtccaggccggtggggggtccctgagtacttcgtcgtgtcggcggtcctctggattcatctactaacaaactnttggatgagcgtgggtccgtgaggtcctccggaagggggaagggggtcgtaggggagggttgggggtcggcccaggcagtcgggaaacgggagagtagggaagtaaaccgaaaaagaacctagtgggtacggacttcgtagggtagggaaccggggtccgtacttccgaacctacgtcctacccgaaaggaacgaaaccgaaaccggaacccaaagaacctacctacgttacgggttaacttacgtacgaataaacgtacgaaacgacgtaacccgtaaaccggaccccggaggaacccgacggggcctttaggttattaacgttacgtcggttacgggcggaaggccgggtaaccccgtcgggtaacccggggtcggggggacccccggggttaccgtccccggttcgggttccccg

SEQ ID NO: 360410 - DNA, 825 bp, Homo sapiens
  misc_feature: GZ8MTXP01EPFCW.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctatttttagaaggtgtccagtgtgaggtgcagctgggtggagttcggtggggggtaggttttggtccaggccggtggggggtccctgagctcgtcgtgtgcggcctcgtggattcatcctactaactaaacttagttggatggagtcgttggggtcccgtcgagggtccgtaccggaagggggaacgggtacgtgggggaggttgggggtcggaccgagacgtaggttaacggaaacggggtaagtaagtaagggaaaacgtaaaaccgaaaaaaggtaacgtaagttacgggtacggtaaccgttcggttagggtacggggaaaccggggtccccgttaaagtttacccaaacccgtacttaccctaacccggaaacgggaaccgaaaacccgaaaccccgggaacccaaaaacgtaaacccttaccgtaccgtttaagggtttaacttaccgttaacgaaaccggaaaattaccggaaaaccgtaaccggaaaccccgtaaaacggacccccgggaaaggaacccggtaacgggtcttagggtttaacgttaacgttttaacgcggttacggacggacgaccgggtaaccccggtaggtaacccggggtccggggggacccccggttaaccgggtccccgttcggggtccccc

SEQ ID NO: 360411 - DNA, 604 bp, Homo sapiens
  misc_feature: GZ8MTXP01AIXNY.2.16.B05.1.454.CMB.2.raw
  modified_base (518)..(518): a, c, t, g, unknown or other
  misc_feature (518)..(518): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccaggccgtggggggtccctgagactctcgtgtgcggctctggattcatctctaacaaactattggatgagctgggtccgtcaggctccgaagggggaggggctgggagtggggtggccagcagtacggaacggagagtagggaaagtaacaaaaaaggtaactagtgtagggacctgtggtaggaaacggggccctattccaacattccaccaagacgaacaaaccgaccaaagaacctcactgggtaatctagacaaaatgaaacagaaccctaagaccccgaggaaccncgggtaactggttgtaattaccgtggtacgcggagacgaacccgcgtaaccggtcggggggaccccggagtccccgttggtccccg

SEQ ID NO: 360412 - DNA, 647 bp, Homo sapiens
  misc_feature: GZ8MTXP01EBI2L.2.16.B05.1.454.CMB.2.raw
  modified_base (182)..(182): a, c, t, g, unknown or other
  misc_feature (182)..(182): n is a, c, g, or t
  modified_base (249)..(249): a, c, t, g, unknown or other
  misc_feature (249)..(249): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgtgcctattttagaaggtntccagtgtgaggtgcagctggtggagtcgtgggggagtttggtccagccgtgggggtccctgagctntcgtgtgcgctcgtggattcatctactaactaaactattggatgagtcgtgggtccgtcgaggctaccggaagggggaagggggcgtgggaggtgggggtgccgaggctagtacggaacggagagtaggaaagtaaacaaaaagtaacgtagtggttagggaactcgtagggtacgggaaacggggtcccgtattccaacctatcctacgaagaacgacaaaccgacctaaaagacctacacttggtaactcgtagaacaaatcgaaacgacgaacctaaacggacccgaaggaccacgggtcttggttacgttaacttaacgtggtacggaccggttagacccggcggtacctaacggggtcccgggggacccggcgtccccgttaacgggtccccg

SEQ ID NO: 360413 - DNA, 632 bp, Homo sapiens
  misc_feature: GZ8MTXP01D6SV6.2.16.B05.1.454.CMB.2.raw
  modified_base (282)..(282): a, c, t, g, unknown or other
  misc_feature (282)..(282): n is a, c, g, or t
  modified_base (368)..(368): a, c, t, g, unknown or other
  misc_feature (368)..(368): n is a, c, g, or t
  modified_base (546)..(546): a, c, t, g, unknown or other
  misc_feature (546)..(546): n is a, c, g, or t
  modified_base (556)..(556): a, c, t, g, unknown or other
  misc_feature (556)..(556): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctgggtggagtcggtgggggtaggttttggccgaggtccggtggggggtccctgagtactcgtcgtgtgcggctcgtggtnttcatctctaacaaactattggatgagctgggtcctgaggctcgagggagggctgggagtgggtcgaccagcagtcggaacggganaagtgggaaataaacaaaaagtaacttagtggtaggactcgtggacggaaacgggccgtattaccaaccatcctacgaaagacaaacaaccgacaaacgaacctcaaacttcggtaatctagaacctaaagtaacgaacgacgtaaacctaacggaacccgaagacgacggtctgttntacgttacgnggttacggacgaggaacggcccgtacgtaaccgggtcgggggaccccggttaccgggtcccgttaacgggtccccg

SEQ ID NO: 360414 - DNA, 649 bp, Homo sapiens
  misc_feature: GZ8MTXP01BR69W.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctggtggagtcgtgggggtaggtttggtccaggccgtggggggtccctgagactcgtcgtgtgcgcctctggattcatctactaacaaaactattggatgagcgtggggtcccgtcaggcctccggaagggggaaggggctgggaggtggggtgccagcagtcggaacggagagtaggaaagtaacaaaaagtaactagtggtagggaactcgtagggtaggaaacggggcccgtattaccaacctatcctacccgaagacgaaccaaaccgaccaaaagaacctacaccgttaggttaatcgtagaacctaaagtacgaaacacgaacccgtaaacggaaccccgaaggaccgacggtcttggttacgttaacttacgtggtacgacgaggacgaacccggcgtaacgggtccggggggacccgttacgccccgttcggtaaccccg

SEQ ID NO: 360415 - DNA, 595 bp, Homo sapiens
  misc_feature: GZ8MTXP01C6DF0.2.16.B05.1.454.CMB.2.raw
  modified_base (291)..(291): a, c, t, g, unknown or other
  misc_feature (291)..(291): n is a, c, g, or t
  modified_base (366)..(366): a, c, t, g, unknown or other
  misc_feature (366)..(366): n is a, c, g, or t
  modified_base (404)..(404): a, c, t, g, unknown or other
  misc_feature (404)..(404): n is a, c, g, or t
  modified_base (537)..(537): a, c, t, g, unknown or other
  misc_feature (537)..(537): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtcggggggtccccgagactcgtcgtgtgcggcctcgtggattcatctctaacaaactnttggatgagctgggtccgtcgaggctccgagggggaaggggctgggaggtggggtggccagcagtggaaaccggngagtggaaagtacaaaaaaaagactgtgtggacttcgngtaggaacggggccattccaacctatctaccgaagaagaaccaacgaccaaagaaacctcaacttcgtaatcctagaacctaaatacgaacacgacctaaacggacccgagacacggctaaggtgttatacgngtcgacaggacgaccgtctacggtccgggggccggacgttcccgtggcccgtaacccg

SEQ ID NO: 360416 - DNA, 674 bp, Homo sapiens
  misc_feature: GZ8MTXP01AQKW8.2.16.B05.1.454.CMB.2.raw
  modified_base (585)..(585): a, c, t, g, unknown or other
  misc_feature (585)..(585): n is a, c, g, or t
  modified_base (634)..(634): a, c, t, g, unknown or other
  misc_feature (634)..(634): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagtcttgggttttccttgttgcctattttagaaggtgtccagtgtgaggtgcagcgtgggtggaggtcgtggggggtaggtttggtccgaggtccggtcggggggtccctggacgtactcgtcggtggtcggccggccttcgtggtattcatctactaacaaactattggatggagtcgtgggtccgtcgacggctccggaagggggagggcgtgggtaggtgggggtcgccgagcgagtacggaacgggagagtaggaaagtaaacgaaaagtaacgtagtagtagggacttcgtaggtaggaacggggtccctaagttccaactacgttccaccgaaggacaaacctaaccggacaaacgactacgacttaggtatcgtagaaactaaagtcgaaactaccggaaacccgtaacggaaaccccggaggaaccccngggtcttaggttgttaacttcgtaggcgacggttagaccggtaacccgngtaaccgggtcgggggaccccggactcccgttcggtaacc

SEQ ID NO: 360417 - DNA, 596 bp, Homo sapiens
  misc_feature: GZ8MTXP01AUILD.2.16.B05.1.454.CMB.2.raw
  modified_base (271)..(271): a, c, t, g, unknown or other
  misc_feature (271)..(271): n is a, c, g, or t
  modified_base (507)..(507): a, c, t, g, unknown or other
  misc_feature (507)..(507): n is a, c, g, or t
  modified_base (513)..(513): a, c, t, g, unknown or other
  misc_feature (513)..(513): n is a, c, g, or t
  modified_base (537)..(537): a, c, t, g, unknown or other
  misc_feature (537)..(537): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggtagtttggtccaggccgtgggggtccctgagactctcgtgtgcggcctcgtggnttcatctactaactaaactattggatgagcgtgggtcctcgaggcctccgagggggaggggcgtgggaggtgggtgaccagcagtacggaacggagagtagggaaagtaaacaaaagtaactagtggtaggactcgtaggtaggaaacgggccctattccacctatccacgaagagaacaacgacaagaactcactgtatcgagacaaatcgaacagaccgtaaagcccgagaccncgggtntgttagtacttcgtggtcgacggngttaccgaacccggcgtaacggggcccgggggacccggacgtcccgttcgggtaacccc

SEQ ID NO: 360418 - DNA, 743 bp, Homo sapiens
  misc_feature: GZ8MTXP01BSU9Q.2.16.B05.1.454.CMB.2.raw
  modified_base (268)..(268): a, c, t, g, unknown or other
  misc_feature (268)..(268): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctatttagaaggtgtccagtgtgaggtgcagcgtgggtggagtcgtgggggtaggtttggtccaggccgtggggggtccctgagactctcgtgtgcgctntggatcatctctacaaactattggatgagcgtgggtccgtcaggctaccggaggggagggctgggaggtgggtggccagcagtacggaaacgggagaagtagggtaaaagtaaacgaaaaaagtaacgttagttagggtacggtaccttgtagggtagggaaacggggtcccgtaaattccccaaaccgtattccccgtaaccgaaagggtaaccaaaccgaaaccggaccccaaaagtaaacccctcaaaccgtttaggggtaacttaccgtagaaaccctaaaagtaccgaaaacccgtaacggaaccccgtaaaacggggaaacccccggaaggtaaaccccgcccgggggtaattggttaacgggttacttttaaacggggtcggtacggaccggttaacggaccgggaacccgtaccgggtaaccggggtcccgggggaccccggttacggtccccgttcgggtaacccg

SEQ ID NO: 360419 - DNA, 815 bp, Homo sapiens
  misc_feature: GZ8MTXP01A77A7.2.16.B05.1.454.CMB.2.raw
  modified_base (269)..(269): a, c, t, g, unknown or other
  misc_feature (269)..(269): n is a, c, g, or t
  modified_base (287)..(287): a, c, t, g, unknown or other
  misc_feature (287)..(287): n is a, c, g, or t
  modified_base (701)..(701): a, c, t, g, unknown or other
  misc_feature (701)..(701): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctggtggagtcgtgggggtagtttggccaggtcgtgggggtccctgagactctcgtgtgcgctctggnttcatctctaacaaactnttggatggagtcgtgggtcccgtcgacggtcctaccggaagggggaacgggggtcgtagggggaggttgggggtcggacccgaggccgaagttacgggaaaccggggaaggtaaggtaagggaaacggttaaaacgaaaaaacggtaacgttaagttagggtacgggtaaccttcgttagggtagggaaacgggggtccctaagtttccaacccgtattcccgaaccgaacggaacgaaaccaaaccggacccaaaaggtaacccttacgtaaccgttaggttaaactttaccgtttaaacaaaacgttacggaaaaccgttaacggaaccccgttaaaaccgggaacccccggaaaggggtaacccgtaccggggttaaccttaacggtttaaggttaaacgttttaaccggnggttaacgggaccggaaacggccggttaaaccccggtccggttaacccgggggtcccgggggggaacccccgggtcgttacccccggggttcgggttccccgttaacccccggg

SEQ ID NO: 360420 - DNA, 704 bp, Homo sapiens
  misc_feature: GZ8MTXP01A1K0S.2.16.B05.1.454.CMB.2.raw
  modified_base (315)..(315): a, c, t, g, unknown or other
  misc_feature (315)..(315): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagcgtggtggagtcggtgggggtaggtttggtccacggccggttcgggggggtcccctggacgtaccgttcgtccggttgtcggcggcctcgtggtattcatctactaacaaactntggatgacgtcgtgggtccgtcaggcctaccggagggggacgggggcgtgggaggtggggtcggaccagcgtagtacggaaacgggagaagtagggaaagtaaaacaaaaaacggtaacttagtacgggtacgggtacttcggtagggtagggaaaccgggtcccgtaattccgaaccattcccaccgaaaggacctaaccgaacgaccctaaagaacctctaacgttgtacttaccagaacctaaagacggaaaccaccggtaaccgaaaaccggcccggaaaggaccctacgggtcttaggttgtaaacgttccgtggcgacgttaggaacccgtccgggacgttaaccggggccgggggaccccgcgtccccgttaaggtcccccg

SEQ ID NO: 360421 - DNA, 637 bp, Homo sapiens
  misc_feature: GZ8MTXP01BQVCZ.2.16.B05.1.454.CMB.2.raw
  modified_base (506)..(506): a, c, t, g, unknown or other
  misc_feature (506)..(506): n is a, c, g, or t
  modified_base (564)..(564): a, c, t, g, unknown or other
  misc_feature (564)..(564): n is a, c, g, or t
  modified_base (573)..(573): a, c, t, g, unknown or other
  misc_feature (573)..(573): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggagtttggtccagccgtggggggtccctgagctctcgtgtgcgcctctggattcatctactaacaaactattgggatggagtcgtggggtcccgtcgaggcctccgaagggggtaagggggctgggaggtggggtggccagcagtcggaacggagatgggaaagtaacaaaagaactagtgtagggactcgtggtagaacggggccctaattccaaccctatcctaccgaaaggacgaaaccgaaaccggacctaaaacgaaaccttccgaaacttggggtaacttccgngaacctaaaatcggaaacaggtacccaaacggaccccgaggacctacgggctaggttntaacttcgngtgcgaggacgaacccgtcgtaaccgggtccgggggaccccggttacgtccccgttaaggtccc

SEQ ID NO: 360422 - DNA, 711 bp, Homo sapiens
  misc_feature: GZ8MTXP01EJGGU.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctatttttagaaggtgtccagtgtgaggtgcagcgtggtggagtcggtgggggtaggtttggtccaggccgtggggggtccctgagactcgtcgtgtgcgcctctggattcatctctaacaaactattggatgagcgtgggtccgtcgaggctaccgagggggaagggggtcgtgggaggtgggggtcggcccaggctagtacggaacggagagtagggaaagtaaacgaaaaagtaacgttagtggtacgggtacttcgtaggttagggaaacggggcccgtaattccaacctagtaccctaccgaaagacgaaaccgaaaccgaccaaacgaacttacacttacggtaactcgtacaacgtaaatcgaaaccgacgaaacccgtaaacggaccccggtaacggaccgacgggtccttaggttagttaaaccgttcgtagggttagacccgggaggttaccgggtaaaccccggtccgtttaacccgggggccggggggacccccgggttacggtccccgggttaaccgggttaacccccg

SEQ ID NO: 360423 - DNA, 594 bp, Homo sapiens
  misc_feature: GZ8MTXP01EXRBK.2.16.B05.1.454.CMB.2.raw
  modified_base (544)..(544): a, c, t, g, unknown or other
  misc_feature (544)..(544): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctgggtggagtcgtgggggaggtttggtccagccgtggggggtccctgagactctcgtgtgcgcctctggattcatctctacaaactattggatgagtcgtgggtccgtcgaggctaccggaggggaaggggctgggagtggggtggccagcagtcggaacggagagtggaagtaacaaaagaactagtgtgactctggtagaacgggccgtattccacatcctcgaagacgaacaacgaccaaagaactacactggtatcctagactaaaatgaaactacgaacccgtaaacggaccccggaaggacccacgggcttagttcggttaattacgtggtcgacggngacggccgtacgtaaccgggtcgggggcccgacggtcccgttgggtcccc

SEQ ID NO: 360424 - DNA, 646 bp, Homo sapiens
  misc_feature: GZ8MTXP01BQNOF.2.16.B05.1.454.CMB.2.raw
  modified_base (599)..(599): a, c, t, g, unknown or other
  misc_feature (599)..(599): n is a, c, g, or t
  modified_base (604)..(604): a, c, t, g, unknown or other
  misc_feature (604)..(604): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagcgtggtggagtcgtgggggtaggtttggtccagccggtggggggtccctgagctctcgtgtcgcgcctcgtggtattcatctactaactaaactgttggatgagtcgtgggtccgtcgaggctaccggaagggggacgggggtcgtggggtaggttgggggtcggcccgagccgagtacggaaacgggagtaggtaagggaacgtaaaacaaaaagaacttaagtggtacggtaacgttcgtagggtacggaaacggggtcctattacccgacctaattcctaccgaaagaacgaaccaaacgaccgaaacgtactaccgacttagggtaacttctacgaactaaagtacgaacacgaccgtaaacgacccgagaccgtcgctgttgtacttcgtggngacgngacgccgtgtaacgggccggggaccggcgtcccgttggtccc

SEQ ID NO: 360425 - DNA, 618 bp, Homo sapiens
  misc_feature: GZ8MTXP01DUNZT.2.16.B05.1.454.CMB.2.raw
  modified_base (561)..(561): a, c, t, g, unknown or other
  misc_feature (561)..(561): n is a, c, g, or t
  modified_base (568)..(568): a, c, t, g, unknown or other
  misc_feature (568)..(568): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctggtggagtcgtgggggagtttggccagccgtggggggtccctgagactctcgtgtgcggcctctggattcatctactaacaaactattggatggagtcgtgggtccgtcaggcctaccggagggggacgggggctgggaggtgggggtgccaggcagtaggaacggagagtaggaaagtaacaaaaagtaactagtggtaggtactcgtagggtaggaacggggtcctattccaacgtatcctaccgaaggaacgaaccaaacgacccaaagtaacctactaccttaggtaactcgtagaaccaaatacgaaacacgtacccaaacggaccgaacggacacggtctgttgtattacgngtcgagngacgaaccgtcgtaacggcgggggacccggacgtcccgttgggtaacccc

SEQ ID NO: 360426 - DNA, 641 bp, Homo sapiens
  misc_feature: GZ8MTXP01BVLGU.2.16.B05.1.454.CMB.2.raw
  modified_base (577)..(577): a, c, t, g, unknown or other
  misc_feature (577)..(577): n is a, c, g, or t
  modified_base (583)..(583): a, c, t, g, unknown or other
  misc_feature (583)..(583): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagcgtgggtggagtcggtgggggtaggtttcggtccaggccggtgggggtccctgagactcgtgtgtgcgctctggattcatctactaactaaactagttggatggagtcgtcgggtcccgtcagggcctaccggaaggggggaacgggggtcgtggggtagggtgggggtcggaccaggcagtacggaacggagagtaggaagtaaaacgaaaagtaactagtggtagacttcgtaggtacgggaaacggtccgtaattaccacgtatccgtacaaaggacgaaccaaccgacaaacgaactcgtacttggtaatctagaactaaatagaacacgaaccgtaaacgacccggagacgacgcttgttacgttacttgngtacgnggaacgacggaaccgtcgtaaccgggtccgggggaccggctcccggttggtaaccccg

SEQ ID NO: 360427 - DNA, 598 bp, Homo sapiens
  misc_feature: GZ8MTXP01D33QA.2.16.B05.1.454.CMB.2.raw
  modified_base (494)..(494): a, c, t, g, unknown or other
  misc_feature (494)..(494): n is a, c, g, or t
  modified_base (536)..(536): a, c, t, g, unknown or other
  misc_feature (536)..(536): n is a, c, g, or t
  modified_base (545)..(545): a, c, t, g, unknown or other
  misc_feature (545)..(545): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctgggtggagtcgtgggggaggtttggtccagccgtggggggtccctgagctctcgtgtcgcggcctcgtggattcatctactaacaaactattggatgagcgtgggtccgtcaggcctacgaagggggaggggtctgggagtggggtgaccagcagtcggaacggagatagggaaagtaacaaaaagaactatggtaggaactcgtggtagggaaacgggcccgtattaccaaccatcctacaagagaaccaacgcaaagactacacttggtactctagacaaagtcgaaacncgaacctaacgacccggagacgacggcttgttagtaattcgnggtcgacgngttaacggcccgtgtaaccgggcgggggaccccggcgtcccggttgggtcccc

SEQ ID NO: 360428 - DNA, 688 bp, Homo sapiens
  misc_feature: GZ8MTXP01AR2IP.2.16.B05.1.454.CMB.2.raw
  modified_base (452)..(452): a, c, t, g, unknown or other
  misc_feature (452)..(452): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagcgtggtggagtcggtgggggtaggtttggtccaggccgtcggggggtccctggagtacttcgtcgtgtcggccggcctcgtggtattcatctactaactaaactattggatgagtcgtcgggtccgtcgaggcgtaccggaagggggaggggcgtgggagggtggggtgccagcagtcggaaacggagagtaggaaagtaaacaaaagtaactagtggtaggactgtaggtagacgggcctataccacgtntccacgaagacgaaccaacgaccaaagtacctctaacgttgtactacgtagaactaaagtcgaaacacggtaacccgaaacggaccccggaaggaaccctcggggtaaccttgggttaagttaacccttcgggttaggtacgggaccgttaaacgggaccggtccccggtacgggttaacccgggggtcccggggggccccggggttaaccttcccccggggttaacggtcccccg

SEQ ID NO: 360429 - DNA, 611 bp, Homo sapiens
  misc_feature: GZ8MTXP01BMQOU.2.16.B05.1.454.CMB.2.raw
  modified_base (296)..(296): a, c, t, g, unknown or other
  misc_feature (296)..(296): n is a, c, g, or t
  modified_base (549)..(549): a, c, t, g, unknown or other
  misc_feature (549)..(549): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctgggtggagtcgtgggggtaggtttggtccaggccgtggggggtcccctggagactcgtcgtgtgcggcctcgtggattcatctctacaaactnttggatgagctgggtccgtcaggctccgaagggggaggggtctgggaggtggggtcggccaggcagtcggaaacggagagtagggaaagtaacaaaagaactagtggtaggactgtggtagggaacgggtccatttccaaccctatcctacgagagaccaacgaccaaagaactacaccttggtatcgtgaacaaagtcgaaacacgacccgtaaagaccccgaggtaccgcggtaactgttagtacttacgngtcgacggagaccggaaccgtggtcccggtcgggggccccggacgtccccgttgggtccccg

SEQ ID NO: 360430 - DNA, 768 bp, Homo sapiens
  misc_feature: GZ8MTXP01A8IR7.2.16.B05.1.454.CMB.2.raw
  modified_base (710)..(710): a, c, t, g, unknown or other
  misc_feature (710)..(710): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaagttggggctggagtcttgggtttttccttgttgcctattttagaaggtgtccagtgtgaggtgcagctgggtggagttcggtgggggtaggtttcggtccgaggtccggtcggggggtccctggacgtacttcgtcggtgtcgcggccttcgtggtacttcatccttacgtaactaaacttagttgggaatggtaagtcgttcggggttcccgtcgaacggggccctaccgggaagggggtaacgggggtcgtaggggacgggttgggggtacggaccccgaggctaaggtacgggaaaccgggaggtaagtaacggggtaaagttaaaaccgaaaaaaagtaaccgttagttcgggtaggtaaaccgtcgttaggggtacggaaacgggggtccctaactttacccgaaacccgtatacccttaccgaaacggaacgaacccaaaaccgacccgaaaacgtaacctctaaccgtaggttactaccgtgaaaccgtaaatcggaaacacggtaacctaaacggaccccgaggacccaacgggtctagttacgtattaccgtggtcgacggnggaccgtaacccggacgttccgggccgggggacccggcgtccccgttcgggtaacccc

SEQ ID NO: 360431 - DNA, 654 bp, Homo sapiens
  misc_feature: GZ8MTXP01CBC9M.2.16.B05.1.454.CMB.2.raw
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
  modified_base (351)..(351): a, c, t, g, unknown or other
  misc_feature (351)..(351): n is a, c, g, or t
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
  modified_base (456)..(456): a, c, t, g, unknown or other
  misc_feature (456)..(456): n is a, c, g, or t
  modified_base (476)..(476): a, c, t, g, unknown or other
  misc_feature (476)..(476): n is a, c, g, or t
  modified_base (485)..(485): a, c, t, g, unknown or other
  misc_feature (485)..(485): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcattttagaaggtgtccagtgtgaggtgcagctgggtggaggtctggggggtaggtttgggtccaggccgtggggggtccctgagactctcgtgtgcgctntggatnatctctacaaactattggatggagcgtgggtccgtcgagggctcccggagggggtagggggcgtgggaggtgggggngggccagggacagtacggaaacgggagagtagggaagtaaaccgaaaagtaagatgtagggactcgtgtaggaggccgatcgaccntcacganagacacgaccanacactactaggtaatcgtanacgtaaacngtaacacggtaacctaaccggacccggaaacggaaccggtaacgggcctttaggttcgttaaacgtttaccggtcggtcggggttaacccgaggaacccgggttccccgggacggtaacccgggttccgggggacccggggggacccgcccgggtttaacccggtcccg

SEQ ID NO: 360432 - DNA, 655 bp, Homo sapiens
  misc_feature: GZ8MTXP01D4MRU.2.16.B05.1.454.CMB.2.raw
  modified_base (249)..(249): a, c, t, g, unknown or other
  misc_feature (249)..(249): n is a, c, g, or t
  modified_base (315)..(315): a, c, t, g, unknown or other
  misc_feature (315)..(315): n is a, c, g, or t
  modified_base (436)..(436): a, c, t, g, unknown or other
  misc_feature (436)..(436): n is a, c, g, or t
  modified_base (487)..(487): a, c, t, g, unknown or other
  misc_feature (487)..(487): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgccatttttagaaggtgtccagtgtgaggtgcagcgtggtggagtcgtgggggtaggtttggtccagccgtggggggtcccngagactctcggtgtgcggcctcgtggattcatctactacaaactattggatgagcgtgggtccgtnacggctaccgaagggggaggggcgtgggaggtgggtgccagcagtacggacggagagtaggaaagtaaaccaaaaagctagtggtacggaactcgtaggtagggaacggccgtatccaacntcctaccaagacgaacaacgaccaaagactactactggtaacttctaaganaaactcgaaacacgaaccctaaacgaccccggaagacccgacgggaacttggttagttaacgtttacgtcgggttcgaacgggcgaaaccggtaacccggtaccggttaaccggggtcccgggggggaccccgggttaaccgttcccgggttcccgggttaaccccgg

SEQ ID NO: 360433 - DNA, 565 bp, Homo sapiens
  misc_feature: GZ8MTXP02F678S.2.16.B05.1.454.CMB.2.raw
  modified_base (415)..(415): a, c, t, g, unknown or other
  misc_feature (415)..(415): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtgggggtccctgagactctcgtgtgcggcctctggattcatctctacaaactattggatgagcgtgggtccgtcaggctccgaggggaaggggctgggaggtggggtggccagcagtgaaacggagagtaggaagtacaaaagactagtgtaggactgtgtgaagggccattccacctatcnccagacgaacaacgccaaagaactacgactgtatctagacaaatcgaacagaccctaaaggaccccgaggacacggcttggtattacttacgtggtagacgagacgaaccgtcgtaacggtcgggggacccggagtccccgtaggtcccg

SEQ ID NO: 360434 - DNA, 529 bp, Homo sapiens
  misc_feature: GZ8MTXP02GPG12.2.16.B05.1.454.CMB.2.raw
  modified_base (406)..(406): a, c, t, g, unknown or other
  misc_feature (406)..(406): n is a, c, g, or t
  modified_base (486)..(486): a, c, t, g, unknown or other
  misc_feature (486)..(486): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagcctggggggtccctgagactctcgtgtgcggcctctggattcatctctacaaactattggatgagctgggtccgtcaggctccgaggggaaggggctgggagtgggtggccagcatgaacggagatggaagtacaaaagactatgtggactcgtgtagaaggggccattcacatcnccagacgacaacgccaaagactcactgatctgacaaaatgaaacagcctaaagccccgaggacacggctgtgtattacgngtgacgagagccgctacgcgggggcccgacgcccgttggaccc

SEQ ID NO: 360435 - DNA, 574 bp, Homo sapiens
  misc_feature: GZ8MTXP02FX390.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccaggccgtggggggtccctgagactctcgtgtgcggcctctggattcatctctacaaactattggatgagcgtgggtccgtcaggctccgaggggaaggggctgggaggtggggtggccagcagtggaacggagagtggaaagtacaaaagactagtggtggactcgtggtagaaggggccattccacatctacagacgacaacgccaaagactacactgtatctagacaaaatcgaaacaggaccctaaaggaccccgaaggaccacggcttggtagtattacgtggtacgacgaaggacgaaccgtcgtaacgggtcgggggaccccggtagccccgtggtaccc

SEQ ID NO: 360436 - DNA, 562 bp, Homo sapiens
  misc_feature: GZ8MTXP02HLO98.2.16.B05.1.454.CMB.2.raw
  modified_base (515)..(515): a, c, t, g, unknown or other
  misc_feature (515)..(515): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtgggggtccctgagactctcgtgtgcggctctggattcatctctacaaactattggatgagctgggtccgtcaggctccgaggggaaggggctgggaggtggggtggccgagcagtcggaaacggagagtaggaagtacaaaagactagtgtaggactgtaggtagaagggcccgattccaaccatcctccaagacgaacaacgaccaaagaacctcaactgtactctagacaaatcgaaacacgacctaaacgacccgagacacggctgtgtactacgtgngcgagacgtaaccgcgtacggtcgggggccggtactccgtggtcccg

SEQ ID NO: 360437 - DNA, 544 bp, Homo sapiens
  misc_feature: GZ8MTXP02I42HR.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgccatttagaaggtgtccagtgtgaggtgcagctggtggagtctgggggaggtttggtccagccgtgggggtccctgagactctcgtgtgcggcctctggattcatctctacaaactattggatgagctgggtccgtcaggctccgagggaaggggctgggagtggggtggccagcagtgaacggagatgggaagtacaaaagactatgtaggactctgtgaagggccgattcaccatctccagagacaacgccaaagaactcacggtatctgacaaatgaaacagacctaagacccgaggacacgggctagtgtattacgtgtacgcgaagacgaccgcgtacgtcgggggacccgggacgcccgtggtacctacccg

SEQ ID NO: 360438 - DNA, 587 bp, Homo sapiens
  misc_feature: GZ8MTXP02JMQ29.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctgagactctcgtgtgcggcctctggattcatctctaacaaactattggatgagcgtgggtccgtcaggctccgaggggaaggggctgggagtggggtgccagcagtggaacggagataggaaagtacaaaaagactagtggtaggactcgtgtaggaaaggggccattcccaactatctccgaagacgaacaaacgccaaagtaactcaactgtaacttcagactaaaatcgaaacacgacctaaaggaccccgaaggacacgggtctaggtagttaatacgtgtaggaccgaagacgaacccgcgttaacggcgggggacccggacgtccccgtgggtaccc

SEQ ID NO: 360439 - DNA, 651 bp, Homo sapiens
  misc_feature: GZ8MTXP02FMDLI.2.16.B05.1.454.CMB.2.raw
  modified_base (196)..(196): a, c, t, g, unknown or other
  misc_feature (196)..(196): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcgtgtttcgtgtaggccatttagaaggtgtcagtgtgaggtgcagngtggtggagtgtggggtaggttggtcgagccggtcggggtccgtgagactcgtcgtgtgcgctcgtgtatctatctctaactaaactattagtagtgagcgtcggtccgtcgacggcgtaccggagggaagggcggtgggtaggtgggtcggccgagacgagtacggaacggaagagtaggtaaagtaaacgaaaaagtaacgtaagtagtaggtacgtacgtaggtaggaacgggaccgtacgttacctacctactacctaccgaacgaacgaacgaaaccgaaccgaaacgtaaactacctaacgtacgtactactagaactaaataacgaaacgaacgtaaccgtaaacgaaccggaacgaacgaacggtacgtagttagttacgttacgtagtacgacgacgacgaaccgtacgtaccggtacgggacccgggaccggtccgtacgtaccg

SEQ ID NO: 360440 - DNA, 551 bp, Homo sapiens
  misc_feature: GZ8MTXP02IASSA.2.16.B05.1.454.CMB.2.raw
  modified_base (272)..(272): a, c, t, g, unknown or other
  misc_feature (272)..(272): n is a, c, g, or t
  modified_base (491)..(491): a, c, t, g, unknown or other
  misc_feature (491)..(491): n is a, c, g, or t
  modified_base (504)..(504): a, c, t, g, unknown or other
  misc_feature (504)..(504): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctggtggagtcgtgggggaggttttgggtccagccgtggggggtccctgagctctcgtgtgcggcctctggnttcatctctacaaactattggatgagctgggtccgtcaggctccgaggggaaggggctgggagtgggtggccagcatggaacggagatggaagtacaaaagactagtggtaggactctggtagaagggcccgtattccaccatcctccagacgacaacgaccaaagaactacactagtatctagacaaaatgaaacagaccaacgacccgagacacggntgtgtatttacgngtcgacgagacgaaccgctacggcggggacccggacgtcccgtggcc

SEQ ID NO: 360441 - DNA, 645 bp, Homo sapiens
  misc_feature: GZ8MTXP02H3PPD.2.16.B05.1.454.CMB.2.raw
  modified_base (308)..(308): a, c, t, g, unknown or other
  misc_feature (308)..(308): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctggtggagtcgtgggggaggtttggtccagccgtgggggtccctgagactctcgtgtgcggcctctggattcatctctaacaaactattggatgagctgggtccgtnaggcctcgaggggaagggctgggagtgggtggccagcagtcggaaacgggagagtagggaaagtacgaaaaagacttataggtggacttcgtggtaggaaagggggtcccgaattccaacccgtatccctacccgaagacgaacaaaccggcccaaagaaaccttcaacttgtaactccgtagaacctaaaatacgaaacaacgaccctaaaacggacccccggaagggaaccaccgggtactaggtttagttaaactttaccgtggttacggacgaaggaacggaaccccgtcgttaaccggccggggggaccccggacgtccccgttgggacccc

SEQ ID NO: 360442 - DNA, 663 bp, Homo sapiens
  misc_feature: GZ8MTXP02JJ2WF.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtgggggtccctgagactctcgtgtgcggcctctggattcatctctaacaaactattggatgagcgtgggtccgtcgaggctccgaggggaaggggcgtgggaggtggggtggccagcagtcggaacggagagtaggaaagtacgaaaagactagtaggtagggtactcgtaggtaggaaacgggggcccgtaatttcccgaacctagttccctacccgaaaggaaccggaaacccaaaccggacccaaaagaaccttaccaaccttaggtaactcgtagaccaaaatcggaaacacgtacctaaacggaccccggaaggaaccacgggtcttaggttagtaactttacgtggtacgaccggaaggacggaacccgtcgttaaccggggtcggggggacccccgggtacgcccccggttaggggtaccccc

SEQ ID NO: 360443 - DNA, 598 bp, Homo sapiens
  misc_feature: GZ8MTXP02JBG59.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctggtggagtcgtgggggaggtttggtccaggccgtggggggtccctgagactctcgtgtgcggcctctggattcatctctacaaactattggatgagcgtgggtccgtcgaggctccgaggggaaggggctgggaggtggggtggccagcatggaacggagagtaggaagtacaaaaagactagtggtaggactcgtggtaggaaacggggccctaattccgaacctatcccgtacccgaaagacgaaaccaaaccgaccaaaagaacctacaacttagtaactcgtagaacaaaatcgaaacagaccctaaacgacccgaagacacggctgtagtactacgtgtcgacgagacgaaccgcgtacggtcgggggacccggacgtccccgtaggcccg

SEQ ID NO: 360444 - DNA, 638 bp, Homo sapiens
  misc_feature: GZ8MTXP02JXKLA.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctgagactctcgtgtgcggctctggattcatctctacaaactattggatgagctgggtccgtcaggctccgaggggaaggggctgggaggtgggtggccaggcagtcggaacggagagtagggaagtacaaaagactagtggtaggactcgtggtaggaaaggggcccgaatttccacctatccctcccgagacgaacaaaccgaccaaagaacctcaacttgtactctagacaaaatcggaaaacacgaccctaaaaggaccccggaaggaacctacggcttaggtacgtaactttaaccgtggttagaccggtaaggaacggaaccccggtacgttaaccggggtccgggggggacccccgggaacggtcccccggtacgggggttacccccg

SEQ ID NO: 360445 - DNA, 598 bp, Homo sapiens
  misc_feature: GZ8MTXP02FZLE6.2.16.B05.1.454.CMB.2.raw
  modified_base (545)..(545): a, c, t, g, unknown or other
  misc_feature (545)..(545): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtgggggtccctgagctctcgtgtgcggcctctggattcatctctacaaactattggatgagctgggtccgtcaggctccgaggggaggggctgggaggtggggtgccgagcagtggaacggagagtggaaagtacgaaaagactatggtaggactcgtaggtaggaacggggtcccgtaatttcccgaaccctagttccctacccgaaggacgaaccaaaccgaccaaaagaacctcaacgtgtactcctagaacaaaatcgaaacacgaccctaaacggaccccgaggaccacggtctggtatacttacgngtcgacgagacgaaccgtcgtacggcgggggacccgacgtcccgtcggtaccc

SEQ ID NO: 360446 - DNA, 569 bp, Homo sapiens
  misc_feature: GZ8MTXP02GT8BI.2.16.B05.1.454.CMB.2.raw
  modified_base (355)..(355): a, c, t, g, unknown or other
  misc_feature (355)..(355): n is a, c, g, or t
  modified_base (452)..(452): a, c, t, g, unknown or other
  misc_feature (452)..(452): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccaggccgtggggggtccctggagactctcgtgtgcggcctctggattcatctctacaaactattggatgagctgggtcctcaggctccgagggaggggctgggagtgggtggccagcagtcgaacggngatgggaagtacaaaaagactagtgtaggactcgtgtaggaacggggccagttccaccatcctccagacgacaacgaccaaagaactcactgtatcngacaaatgaaacagacctaaacgacccgaaggaccacgggtctaggtagttacttacgtggtagaccgaagacgaaccgctaacggtcgggggacccggacgtcccgtagggtcccc

SEQ ID NO: 360447 - DNA, 557 bp, Homo sapiens
  misc_feature: GZ8MTXP02HT1IN.2.16.B05.1.454.CMB.2.raw
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
  modified_base (447)..(447): a, c, t, g, unknown or other
  misc_feature (447)..(447): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctgagactctcgtgtgcggctctggattcatctctacaaactnttggatgagctgggtccgtnaggctccgaggggaaggggctgggaggtgggtggccagcatcggaaacggagatagggaaagtacaaaaagactaagtgtaggacttcgtgtaggaaaggggccgaattccacatctccaagacgacaacgccaaagactnactgtactctgacaaatgaaacagacctaaagacccgagacacggctagtgtacttactgtcgacgagagaaccgcgtacggtcgggggcccggacgccccgttggaccc

SEQ ID NO: 360448 - DNA, 561 bp, Homo sapiens
  misc_feature: GZ8MTXP02GVBPH.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgccatttagaaggtgtccagtgtgaggtgcagctggtggagtctgggggaggtttggtccagccgtgggggtccctgagactctcgtgtgcggcctctggattcatctctacaaactattggatgagctgggtcctcaggctccgagggaagggctgggagtggggtgccagcatgaacggagatggaagtacaaaaagactatggtaggactctagtgaaaggggcccaattccaacccatcctaccaagacgaacaacgaccaaagaactccactgtaactcgtagacaaaatagaacaacgaccaacgaaccgaacggacgaacggacgtagtagtatactcgtagacgagacgaacgacgtacgtacgggccgggaccggcccgtcggtccg

SEQ ID NO: 360449 - DNA, 528 bp, Homo sapiens
  misc_feature: GZ8MTXP02FF8K3.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccgaggggaaggggctgggagtggggtgccagcatgaacggagatggaagtcaaaaagactatgtggactctgtgaagggccgattcaccatctccagagacaaacgccaaagaactcactgtatctgacaaaatgaaacagacctaagacccgaggacacggctgtgtatactgtgcgagagaaccgctacgcgggggcccggacgcccgtggtccc

SEQ ID NO: 360450 - DNA, 563 bp, Homo sapiens
  misc_feature: GZ8MTXP02INNLK.2.16.B05.1.454.CMB.2.raw
  modified_base (506)..(506): a, c, t, g, unknown or other
  misc_feature (506)..(506): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgccattttagaaggtgtccagtgtgaggtgcagctggtggagtctgggggaggtttggtccagccgtgggggtccctgagactctcgtgtgcggcctctggattcatctctacaaactattggatgagctgggtccgtcaggctccgaggggaaggggctgggagtgggtggccagcagtcggaacggagagtaggaagtacaaaagactagtggtggactcgtgtggaaacgggccatcaacatcgtaccagacgacaacgaccaaagactacactgtatctagacaaatgaaacacgacctaaacggacccgaaggaccacggtctagtagtacttacnggtcgacgagacgaacccgtcgtacggtcgggggacccggacgtcccgtggtacccg

SEQ ID NO: 360451 - DNA, 619 bp, Homo sapiens
  misc_feature: GZ8MTXP02F5H3C.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagccgtggggggtccctgagactctcgtgtgcggcctctggattcatctctacaaactattggatgagctgggtccgtcaggctaccgaggggaaggggctgggaggtggggtggccagcagtgaacggagagtaggaaagtacaaaaagactatggtaggactcgtgtaggaagggccgattcaccatcctccgagacgaacaaacgccaaagaactcactgtatctgacaaatcgaaacacgacctaaaacggaccccggaaggacccaacgggtccttaggttagttaaacgtttaacctgggttacggacccggaaggaccggaaaccccggtccgttaaaccggggtcggggggacccccggggaggtccccccgttggggtacccc

SEQ ID NO: 360452 - DNA, 599 bp, Homo sapiens
  misc_feature: GZ8MTXP02JO7HQ.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctggagactctcgtgtgcggcctctggattcatctctacaaactattggatgagcgtgggtccgtcaggctccgaggggaaggggctgggagtggggtggccagcatcggaacggagatagggaagtacaaaaagactagtggtaggactcgtggtaggaaacgggggcccgtagtttcccaacctaatccctacccgaagacggaaccaaacggacccaaaagaacctcaactgtaactctagacaaaatcgaaacacgacctaaagaccccggaaggaccacggctggtagtaacttacgtgtcgacgagacgaaccgcgttaacggcgggggcccggacgcccgtggtacccg

SEQ ID NO: 360453 - DNA, 621 bp, Homo sapiens
  misc_feature: GZ8MTXP02GF1UJ.2.16.B05.1.454.CMB.2.raw
  modified_base (564)..(564): a, c, t, g, unknown or other
  misc_feature (564)..(564): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggtaggtttggtccagccgtggggagtccctgagactctcgtgtgcggcctctggattcatctctaacaaactattggatgagctggggtccgtcgaggctccgaggggaaggggcgtgggaggtggggtcggcctaggcagtaggaaacggagagtagggaaagtaacaaaagaactaagtggtaggacttacgtgtaggaaacggggccctaattccgaaccatcgtaccagaacgaacaaaccgaccaaagaaacctcaaacttgtactacgtagaaccaaaagtgaaaacacggtaaccaaacggaaccccgaaggaaccacgggtcttagtacgtaaattacgngtacggacgaagaacggacccgcgtaaaccggcgggggacccggacgtacccgtcgg

SEQ ID NO: 360454 - DNA, 565 bp, Homo sapiens
  misc_feature: GZ8MTXP02GQLKR.2.16.B05.1.454.CMB.2.raw
  modified_base (459)..(459): a, c, t, g, unknown or other
  misc_feature (459)..(459): n is a, c, g, or t
  modified_base (515)..(515): a, c, t, g, unknown or other
  misc_feature (515)..(515): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccaggccgtggggggtccctgagactctcgtgtgcggcctctggattcatctctacaaactattggatgagctgggtccgtcaggctccgaggggaaggggctgggagtggggtgccagcatagaacggagagtaggaagtacaaaaagactatgtggactcgtgtagaaagggggcctattccaacctatcctccgagacgaacaacgaccaaagaactcaactgtacttcngactaaatcgaaacacgacctaaaacgacccgaggaacacggctgtatacttacgngtacgacgagacgaaccgtcgtacggcggggacccgacgccgtacggccg

SEQ ID NO: 360455 - DNA, 563 bp, Homo sapiens
  misc_feature: GZ8MTXP02F2DJ5.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtgggggtccctgagactctcgtgtgcggcctctggattcatctctacaaactattggatgagcgtgggtccgtcgaggctccgaggggaggggctgggagtggggtggccagcgagtggaacggagagtaggaagtacaaaagactatggtaggactcgtgtaggaaagggcccatttccaccatcctccagacaacaacgccaaaagactcactgtactctagacaaatcgaaacacgacctaaaggaccccgaggaccgacggtctggtatacttacgtgtcgacgagaacgccgctacggcgggggcccggacgcccgtggtacccg

SEQ ID NO: 360456 - DNA, 660 bp, Homo sapiens
  misc_feature: GZ8MTXP02GFP8Q.2.16.B05.1.454.CMB.2.raw
  modified_base (579)..(579): a, c, t, g, unknown or other
  misc_feature (579)..(579): n is a, c, g, or t
tcagacgctcgacacacgaccggtgctcgatttagagctcacgtattgggtttgaggtctcagaggaggagccttagccctggactccaaggcctttccacttggtgatcagcactgagcacagaggactcaccatggaattggggctgagcttgggttttccttgttgcctattttagaaggtgtccagtgtgaggtgcagctggtggagtcgtgggggtaggtttggtccagccggtgggggtccctgagactctcgtgtgcggcctctggattcatctctaacaaactattggatgagcgtgggtccgtcgacggctaccggagggggaaggggctggggaggtggggtcggccgagacagtacggaaacggagagtagggaaagtaacaaaaagtactagtggtaggacttcgtaggtagggaaaggggccctattacccaacctattccctacccgaaggacgaaccaaaccggaccaaaagaactacgacttagtatcctagaacaaatcgaaacacggaacctaaacggaccccgaaagtaccgacggtcttaggtagttaactttaccggnggtacgacggaacggaaccggtaacccgtacgttaacccgggggccgggggaccccggtacggccccggttacggtacccg

SEQ ID NO: 360457 - DNA, 628 bp, Homo sapiens
  misc_feature: GZ8MTXP02G3S3O.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctgggtggagtcgtgggggaggtttggtccaggccgtggggggtccccgagactctcgtgtgcggcctctggattcatctctaacaaactattggatgagcgtggggtcctcgaggctaccgaggggaaggggctgggaggtggggtggccagcagtagaaccggagatggaaagtacaaaaagtactagtgtaggacttcgtaggtaggaaacggggcccgtacgttaccacctacttacgacccgaagaacgaaccaaacgacccgaaaacgaaccttacaaacgtagttactcgtagactaaaagtacgaaaacacgaccgtaaacggacccgaggaaccacggactacgtagttattacgtgtcgacgacggacgaaccgcgtaacggtcgggggacccggacgcccggtacggcccgtacccgg

SEQ ID NO: 360458 - DNA, 634 bp, Homo sapiens
  misc_feature: GZ8MTXP02H6H0I.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgagtgcagctggtggagtcgtgggggaggtttggtccagccgtgggggtccctgagactctcgtgtgcggcctctggatcatctctaacaaactattggatgagctgggtccgtcaggctccgaggggaaggggcgtgggaggtggggtggccagcagtcgaacgggagagtagggaaagtacgaaaaagtactagtagtaggactcgtggtagaaggggcccgtaattcccaacccgattcccgtacccgaaaggaacgaaccaaaacggacccaaagtaaaaccctccaaacgttgttaaattccgagaaccaaaagttgaaaaccaggaaccctaaaggaccccgaggaaccacgggtctaggtcgttaatacgtgtacgacgtagacggaacccgcgtaaccgggtcgggggccccgggaactcccccgttagggacccc

SEQ ID NO: 360459 - DNA, 552 bp, Homo sapiens
  misc_feature: GZ8MTXP02JA6Y8.2.16.B05.1.454.CMB.2.raw
  modified_base (356)..(356): a, c, t, g, unknown or other
  misc_feature (356)..(356): n is a, c, g, or t
  modified_base (435)..(435): a, c, t, g, unknown or other
  misc_feature (435)..(435): n is a, c, g, or t
  modified_base (461)..(461): a, c, t, g, unknown or other
  misc_feature (461)..(461): n is a, c, g, or t
  modified_base (501)..(501): a, c, t, g, unknown or other
  misc_feature (501)..(501): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctgagactctcgtgtgcggcctctggattcatctctacaaactattggatgagcgtgggtccgtcaggctccgaggggaggggctgggagtgggtggccagcatcggaacggngatggaagtacgaaaagactatggtaggactcgtgagaaggggccattccgaccatcaccagacacaacgcaaagactnactgtactctgactaaaatcgaaacngacctaaagacccgaagacacggtctagtgtaacttacgngtcgacgagacgaaccgcgtaacggcgggggacccgacgccccgtggtccc

SEQ ID NO: 360460 - DNA, 728 bp, Homo sapiens
  misc_feature: GZ8MTXP02HFDD4.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtgggggtccctgagactctcgtgtgcggcctctggattcatctctacaaactattggatgagctgggtccgtcaggctccgaggggaaggggctgggaggtggggtggccagcagtggaacggagatagggaaagtacaaaagactatagtaggactcgtggtagaaaggggcccgtattccgaaccattcctacccgaaaggacgaaccaaaaccggacccaaaaggtaaacctaccaaaccgtttaggttaaacttaccgttacggaaaccctaaaaagttaccggaaaaacccaacggaacccccttaaaaacggggaacccccggaaaacggggtaacccgaaacccgggggtaccttaggggtttacgttaaaacgttttaaccgtacggttacgggaacccggtaaaggaaccggaaccccggtacgttaaaccggggtccgggggggacccccggggaacggtcccccggttacgggggtaacccccg

SEQ ID NO: 360461 - DNA, 651 bp, Homo sapiens
  misc_feature: GZ8MTXP02ISB0U.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctgagactctcgtgtgcggcctctggattcatctctacaaactattggatgagcgtgggtccgtcgaggctccgaggggaaggggcgtgggaggtggggtggccgagcagtggaacggagagtaggaagtacaaaagactagtgtaggactcgtagtaggaacggggcctattccaaccgtactcctacccgaagacgaacaaacgacccaaaagacctacacgttgtactctagaacaaaatacgaaacacgacccgtaaaaggacccccgaagggaacccaacgggtcttagggtacgtttaaacgttaacgtggtacggaaccggaaggtaaccggaaccccggtacgtttaaaccggggccggggggacccccggggaccggtcccccggttagggtacccccg

SEQ ID NO: 360462 - DNA, 618 bp, Homo sapiens
  misc_feature: GZ8MTXP02JXLGE.2.16.B05.1.454.CMB.2.raw
  modified_base (442)..(442): a, c, t, g, unknown or other
  misc_feature (442)..(442): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctgggtggagtcgtgggggaggtttggtccagccgtgggggtccctgagactctcgtgtgcggcctctggattcatctctacaaactattggatgagcgtgggtccgtcgaggctaccggaggggaacggggcgtgggaggtggggtcggccagcagtacggaacggagagtaggaaagtaacaaaagactagtaggtacggacttcgtaggtaggaaacggggcccgtaattcccaacctnttaccacccgaagacgaaaccgaaacgcaaagactaccacgttgtatcgtacgaactaaaagtcgaaacaacgtacccgtaaaggaccccggagacgacgtcgttgtagttactacgtggtacgacgtagaccgaaccgcgttacgggccgggggacccgactcccggtgtccccg

SEQ ID NO: 360463 - DNA, 680 bp, Homo sapiens
  misc_feature: GZ8MTXP02ICOJC.2.16.B05.1.454.CMB.2.raw
  modified_base (286)..(286): a, c, t, g, unknown or other
  misc_feature (286)..(286): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctggtggagtcgtgggggaggtttggtccagccgtgggggtccctgagctctcgtgtgcggcctctggattcatctctacaaactnttggatgagcgtgggtccgtcgaggctccgaggggaaggggctgggaggtgggtggccgagcagtacggaaacgggagagtagggaagtaacgaaaaagactagtggtagggtactcgtaggtaggaaacggggccctaattcccaaccctatcccgtaccgaaaggaaccgaaaccaaacccggacccaaaacggtaacctaccgtaaaccgtttggtaaacttcgtacgaacctaaaagtacggaaaacacgtaccctaaaacgggacccccggaagggacccgtacggggtactggttacgttaacgtttacggaggtacggacgtaacggaccggtaacccggtacgtaccggggccgggggaccccggtacgtccccggtacggtcccg

SEQ ID NO: 360464 - DNA, 599 bp, Homo sapiens
  misc_feature: GZ8MTXP02G2ZWP.2.16.B05.1.454.CMB.2.raw
  modified_base (547)..(547): a, c, t, g, unknown or other
  misc_feature (547)..(547): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagccgtggggggtccctgagactctcgtgtgcggcctctggattcatctctaacaaactattggatgagctgggtccgtcaggctccgaggggaagggcgtgggaggtgggtggccagcagtacgaacggagagtaggaagtacaaaagactatgtagggactcgtggtaggaaaggggcctaattccaaccctagtccctacccaaaggacgaaccaaaccggacccaaaagtaacctacacgttgtaactcgtagacaaaagtcgaaaccagaaccctaaaggaccccgagggaccacgggctagtagtacttacggngtacgacgagacgccgacgtaccggtcgggggcccgacgtcccgtaggtccc

SEQ ID NO: 360465 - DNA, 661 bp, Homo sapiens
  misc_feature: GZ8MTXP02G4A6M.2.16.B05.1.454.CMB.2.raw
  modified_base (281)..(281): a, c, t, g, unknown or other
  misc_feature (281)..(281): n is a, c, g, or t
  modified_base (354)..(354): a, c, t, g, unknown or other
  misc_feature (354)..(354): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcgtggtttctgtgccatttagaaggtgtcagtgtgaggtgcagctggtggagtcgtgggggaggtttggtccagccgtggggggtccctgagactctcgtgtgcggctctggattcatctctaacaaactnttggatgagcgtgggtccgtcaggcctacgaggggaaggggctgggaggtgggtgccagctagtggaaacggnagtagggaatacaaaaagactatggtaggactcgtggtaggaaacggggcctaattccaacctatcctaccgaagggacggacaaaccggacctaaaagaacctacacttaggtaacttccgtaacgaactaaacgtaacgaaacgaacggaaccgtaaaccggaaacccggaaaccgggaaccggaaccggtacggttacggttacgttaacgttacgtacggtacggtacggaacggaaccggtaaccggtaccggtaccggggtaccgggggacccggggacccggtacccggtaccggtaccg

SEQ ID NO: 360466 - DNA, 631 bp, Homo sapiens
  misc_feature: GZ8MTXP02JQMLV.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctgagactctcgtgtgcggcctctggattcatctctaacaaactattggatgagcgtggtccgtcaggctccgagggaaggggctgggagtggggtggccagcatggaacggagagtggaagtacaaaaagactagtgtacggactcgtggtaggaaacggggccaattccgaccctattctacccaagacgaaccaaacggaccaaaaggaaccttaccaacttagtaaacttccgaagaccaaaagtcgaaaacacggtaaccctaaaaggaacccccggaggaaacccgacggggtctaggttagttaaagttacctggtcgacggaagacgtaacccggcgtaaccggtcgggggaccccgtacggcccccgttaggtaccccg

SEQ ID NO: 360467 - DNA, 586 bp, Homo sapiens
  misc_feature: GZ8MTXP02HI1QD.2.16.B05.1.454.CMB.2.raw
  modified_base (307)..(307): a, c, t, g, unknown or other
  misc_feature (307)..(307): n is a, c, g, or t
  modified_base (452)..(452): a, c, t, g, unknown or other
  misc_feature (452)..(452): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggccagccgtggggggtccctgagactctcgtgtgcggcctctggattcatctctacaaactattggatgagcgtgggtccgtnaggctccgaggggaaggggctgggaggtgggtggccagcagtcggaaacggagagtaggaagtacaaaaagactatgtaggactcgtgtaggaagggcctattaccaccgattccacccgagacgaccaaacgaccaaagacctnacttgaacttctagacaaaagtcgaaacacgacctaaacggacccgaaggcaacggctagttgtaactttacggtgtcgacggagtacggaaccgcgttaacggcggggggcccgacgtccccgtgggtacccc

SEQ ID NO: 360468 - DNA, 660 bp, Homo sapiens
  misc_feature: GZ8MTXP02HQXJJ.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggacccaccatggaattggggctgagcgtggtttctgtagccatttagaaggtgtcagtgtgaggtgcagctggtggagtcgtgggggagtttggtccagccgtgggggtccctgagactctcgtgtgcggcctgtggattcatctctaacaaactattggatgagcgtgggtccgtcgaggctccgaaggggaaggggcgtgggaggttggggcggccaagtcgagtaggaaaccgggagaagtaggaaagtacaaaaaggtaactgtagtggaactcgttgaggaaagggtccctaattcaacctatccaccaagacgaacaaaccggaaccaaaagttaaccctactaacgtagtactacgtagaacaaactaacgaaacgaacgaaccgtaaaccggaaacccggaaaccggaaccgaaccggtacgtacgttacgttacgttacgtacggtacggacgaacggaacggaccggtaaccggtaccgggtaccggggacccggggaccggtacccggtccggtaccgtacccg

SEQ ID NO: 360469 - DNA, 546 bp, Homo sapiens
  misc_feature: GZ8MTXP02JKXD0.2.16.B05.1.454.CMB.2.raw
  modified_base (385)..(385): a, c, t, g, unknown or other
  misc_feature (385)..(385): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtgggggtccctgagactctcgtgtgcggcctctggattcatctctacaaactattggatgagctgggtccgtcaggctccgaggggaaggggctgggagtgggtggccagcatggaacggagatgggaagtacaaaagactatggtggactntgtgaaggggcccgattccaccatctccagagacaacgccaaagactcactgtatcagacaaaatgaaacagacctaaagacccgaggacacggctgtgtaacttactgtgacgaagagaacccgcgttaacggcgggggccccggagccccgtggtaccc

SEQ ID NO: 360470 - DNA, 622 bp, Homo sapiens
  misc_feature: GZ8MTXP02IV097.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctggtggagtcgtgggggtaggtttggtccaggccgtgggggtccctgagactctcgtgtgcggcctctggatcatctctacaaactattggatgagcgtgggtccgtcgaggcctaccggaggggaggggcgtggggaggtggggtggccgaggcagtcggaaacggagagtagggaagtaacaaaaagacgtatggtaggactcgtggtaggaaacggggcccgtattaccactatcctaccgagacgacaaacgccaaagacctcatgaatctagaacaaaatcgaaacacgaccgtaaacggaccccgaagggaccgaccggtctggttagtaactttacgtggtacgacggaaaggacgaaccccggtacgttaaccggggccgggggtaacccgggcgccccgtttaggacccccg

SEQ ID NO: 360471 - DNA, 578 bp, Homo sapiens
  misc_feature: GZ8MTXP02INDQC.2.16.B05.1.454.CMB.2.raw
  modified_base (423)..(423): a, c, t, g, unknown or other
  misc_feature (423)..(423): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgccattttagaaggtgtccagtgtgaggtgcagctgggtggagtcgtgggggaggtttggtccagccgtgggggtccctgagactctcgtgtgcggcctctggattcatctctacaaactattggatgagctgggtccgtcaggcctccgaggggaagggctgggaggtgggtggccagcagtcggaacggagagtaggaatacgaaaaagacgttatggtagggactcgtggtagaaggggcctatccacatccncaagacgacaacgaccaaagactcactgtaatcctagactaaaatcgaaacacgaccgtaaaacggaccccgaaggacgtacggcttgtacgtacttacgtgtcgacgtagacgcccgtacgtacggtcgggggacccgacgcccgtggtacccc

SEQ ID NO: 360472 - DNA, 627 bp, Homo sapiens
  misc_feature: GZ8MTXP02JIFNL.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggtaggtttggtccagccgtgggggtccctgagactctcgtgtgcggcctctggattcatctctacaaactattggatgagcgtggtccgtcgaggctccgaggggagggcgtgggaggtgggtcggccagcagtacggaacggagagtagggaagtaacgaaaagtactagtggtaggtactcgtaggtaggaacggggcctattacccacctatcctaccgagacgaacaaccgacaaacgaactcacttagtactcgtagaactaaaatcgaaaactacgacccgtaaacggaccccggaaggaccgacggtacttggtagttaacgttacgtggtcgacggaacggtaacgaacccggtacgttaaccggggcggggggaccccgtacggtccccggtaggtaccccg

SEQ ID NO: 360473 - DNA, 619 bp, Homo sapiens
  misc_feature: GZ8MTXP02JK1QT.2.16.B05.1.454.CMB.2.raw
  modified_base (289)..(289): a, c, t, g, unknown or other
  misc_feature (289)..(289): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccaggccgtggggggtccctgagactctcgtgtgcggcctctggattcatctctaacaaactnttggatgagcgtgggtccgtcgaggctccgaggggaaggggctgggaggtggggtggccagcagtacggaacggagagtagggaagtaacaaaagactagtggtaggactcgtaggtaggaaacgggggcctaagttcccaaccctagtacctacccgaagaaccgaaaccaaaccggaccaaaacgaacctacaacttgtaactccgtagacaaaagtcgaaacacgacctaaacggacccgaaggaccgaacggtctggtacgtacttacgtgtacgacgaagacgaacgcgtacggtcgggggacccggacgtcccgtcggtacccg

SEQ ID NO: 360474 - DNA, 743 bp, Homo sapiens
  misc_feature: GZ8MTXP02FZL0D.2.16.B05.1.454.CMB.2.raw
  modified_base (312)..(312): a, c, t, g, unknown or other
  misc_feature (312)..(312): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctggtggagtcgtgggggtaggtttggtccaggccgtgggggtccctgagctctcgtgtgcggcctcgtggattcatctactaacaaactattggatgagcgtgggtccgtnacggtctaccggaggggaggggcgtagggaggtggggtcggccaggcagtaggaacggagaagtagggaaagtacgaaaaagtactagtaggtacggtaaccttcgtagggtacgggaaacggggtccctaaagtttcccaaacccgtaattcccgtacccgaaaggaaccgaaaccgaaaaccggacccaaaaagaacccttaccgtaaacgtttggttaacttaccgtagaaaccaaaagttacggaaaaccgacggtaaccccgtaaaaacggacccccggaagggaaccccgaacggggtacctttagggtttacggtttaaactttacggtgggttacggaaccggtaggaacccggtaaccccggtacggtacccggggtaccggggggacccccgggacgttcccccggttagggtaacccccg

SEQ ID NO: 360475 - DNA, 711 bp, Homo sapiens
  misc_feature: GZ8MTXP02F3873.2.16.B05.1.454.CMB.2.raw
  modified_base (355)..(355): a, c, t, g, unknown or other
  misc_feature (355)..(355): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctgagactctcgtgtgcggcctctggattcatctctacaaactattggatgagctgggtccgtcaggctccgaggggaggggctgggagtggggtggccagcagtgaacggngagtggaagtacaaaaagactatggtggacttcgtaggtaggaaacggggacccgatttaccaacccaagttcccttacccgaaggaacgaaaccaaaacccgggcccaaaaacggaaccttaccaaaccgtttaggttaaacttccgttaacggaacctaaaaagttacggaaaacctacggaaacccgttaaaacggaacccccggtaaaggggaccctaaaccgggggtcctttaggggttaccgtttaaacgtttaccggttaaggttcgggaccgggaaacgtacgggaaccccgtacgtaaccggggttcggggggacccccggggaacgtccccggttcgggtaccccg

SEQ ID NO: 360476 - DNA, 713 bp, Homo sapiens
  misc_feature: GZ8MTXP02GXNLT.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctggggttttccttgttgccattttagaaggtgtccagtgtgaggtgcagctggtggagtcgtgggggaggtttggtccaggccgtggggggtccctgagactctcgtgtgcggcctctggattcatctctacaaactattggatgagcgtgggtccgtcaggctccgaggggaaggggctgggaggtggggtggccgagcagtcggaacgggagagtgggaaagtacaaaagactagtggtacggactcgtaggtaggaaacggggcccgtaatttccgaacctacgttcccttacccgaaaggaacgaaaccgaaaaccggacccaaaaacggaaccctaccaaccgtttaggttaacttcgtacgaacgtaaaaacgtacggaaaaccacggtaaccccgttaaaacgggaacccccgggaaacggggaacctaaaccgggggtccttacggttagttaacgtttaaccgtgggttacggacccggaaggtacggaaccccggtacgtaaccggggtcggggggacccccgggacggccccggttacggggttacccccg

SEQ ID NO: 360477 - DNA, 553 bp, Homo sapiens
  misc_feature: GZ8MTXP02F596H.2.16.B05.1.454.CMB.2.raw
  modified_base (502)..(502): a, c, t, g, unknown or other
  misc_feature (502)..(502): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccaggccgtggggggtccctgagactctcgtgtgcggcctctggattcatctctacaaactattggatgagctgggtccgtcgaggctccgaggggaggggctgggagtggggtgccagcagtcggaacggagagtaggaagtacaaaagactatggtgactgtgtgaagggccgtattccacatctaccagacgacaacgcaaagactcactgtatctagacaaatcgaaacagacctaaagaccccgaggacacgggctaggtattacttacgngtcgacgagacggaaccgcgtacggtcgggggcccggagcccgtggtcccg

SEQ ID NO: 360478 - DNA, 624 bp, Homo sapiens
  misc_feature: GZ8MTXP02GHIXU.2.16.B05.1.454.CMB.2.raw
  modified_base (584)..(584): a, c, t, g, unknown or other
  misc_feature (584)..(584): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagccgtggggggtccctgagactctcgtgtgcggcctctggattcatctctacaaactattggatgagctgggtccgtcaggctccgaggggaaggggctgggaggtggggtggccagcatcggaacggagagtggaaagtacaaaaaggactagtggtaggactcgtggtaggaaacggggtcccgatttccaaccgtaatccgtacccaaggacgaaccgaaaccgacccaaaagaaaccttaccaacttggtaactctaggactaaaatcggaaacacggaccctaaaacggacccggaagggaccacgggtactggtacgttaattactggtcgaccggaagacggaacccgngtaaccggtcgggggaccccggagccccgtgggtaccccg

SEQ ID NO: 360479 - DNA, 629 bp, Homo sapiens
  misc_feature: GZ8MTXP02JPO4P.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccaggccgtggggggtccctgagactctcgtgtgcggcctctggattcatctctacaaactattggatgagcgtgggtccgtcgaggctaccgaggggaaggggcgtgggaggtggggtggccgaggcagtacggaaacggagagtagggaaagtaacaaaaagactaagtggtaggactcgtggtaggaacggggcccgtattcccgaacccaccctccgaagaacgacccaaacgacccaaagacctcaaccttgtacttcgtagacctaaaagtcgaaaaccaggaaccctaaacggacccgagggaaccacgggacttggtagttacttacgtgtcgacgaacgacgacccgcgtacgggtccgggggacccggggactccccggttggaccctacccg

SEQ ID NO: 360480 - DNA, 608 bp, Homo sapiens
  misc_feature: GZ8MTXP02JLKED.2.16.B05.1.454.CMB.2.raw
  modified_base (308)..(308): a, c, t, g, unknown or other
  misc_feature (308)..(308): n is a, c, g, or t
  modified_base (419)..(419): a, c, t, g, unknown or other
  misc_feature (419)..(419): n is a, c, g, or t
  modified_base (454)..(454): a, c, t, g, unknown or other
  misc_feature (454)..(454): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgccattttagaaggtgtccagtgtgaggtgcagctggtggagtcgtgggggaggtttggtccaggccgtgggggtccctgagactctcgtgtgcggcctcgtggattcatctctaacaaactattggatgagcgtggtccgtnaggctccgaggggagggcgtgggaggtgggtggccagcagtcggaacggagagtaggaagtacaaaagactagtgtggactcgtggtaggaacggggcctattccaacctntcctaccgaagacgacaaaccggccaaagaacctnaacttggtaactcgtagaactaaaatcgaaacacgaacccgtaaacgaccccggaaggaaccgacgggtcttaggtagtaacttacgtggtcgacggaagacggaacccgtacgtaccgggtccgggggacccggtacgccccgttaggtaccc

SEQ ID NO: 360481 - DNA, 691 bp, Homo sapiens
  misc_feature: GZ8MTXP02JHGLS.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagccgtgggggtccctgagactctcgtgtgcggcctcgtggattcatctctacaaactatggatgagcgtgggtccgtcaggctccgaggggaaggggctgggaggtggggtggccgagcgagtcggaacggagataggaagtacaaaaagactagtggtaggactcgtaggtagaacgggggtccctaagtttcccaaccctaattccctacccgaaagacgaacaaaccggccaaaaagtaaccttaccaccgttagtaaacttcgtacgaacgtaaaaagtcggaaaacctacggaaccccgtaaaacggaacccccgggaaagggaacccgaacccggggttacttaggtttaacgttaaacgttacggtacggtacgaaccgggtaacgaacggtaaccccggtacggttaccgggggtacccgggggccccggacggtccccggttacgggtaccccg

SEQ ID NO: 360482 - DNA, 581 bp, Homo sapiens
  misc_feature: GZ8MTXP02JKNLW.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggtaggtttggtccaggccgtggggggtccctgagactctcgtgtgcggcctctggattcatctctacaaactattggatgagcgtgggtccgtcaggctccgaggggaaggggctgggaggtggggtggccagcgatcggaacggagatagggaaagtacaaaaagactagtggtggactcgtaggtagaacggggtccattcaccatctaccagacgacaacgcaaagaactcactgtactctagacaaaagtcgaaacacgaccctaaaggaccccggaaggaccacggcttaggtgtaacttacgtgtacgacgagacgaacccgcgttaaccggcgggggaccccgacgtccctggtaccc

SEQ ID NO: 360483 - DNA, 538 bp, Homo sapiens
  misc_feature: GZ8MTXP02J4MMI.2.16.B05.1.454.CMB.2.raw
  modified_base (448)..(448): a, c, t, g, unknown or other
  misc_feature (448)..(448): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggagttttggtccagcctggggggtccctgagactctcgtgtgcggcctctggattcatctctacaaactattggatgagctgggtccgtcaggctccgaggggaaggggctgggagtggggtggccagcatgaacggagataggaagtacaaaagactatgtggactctgtggaacggggcattcacatcgccagacgacaaacgccaaagaactcaactgtatctgacaaanagaacacgacgaacggaccgacggacgacgcgtgtgttattacgtgtcgcgagacgaaccgcgtacgtcgggccgggccggccgtcgtcg

SEQ ID NO: 360484 - DNA, 581 bp, Homo sapiens
  misc_feature: GZ8MTXP02HXQJT.2.16.B05.1.454.CMB.2.raw
  modified_base (459)..(459): a, c, t, g, unknown or other
  misc_feature (459)..(459): n is a, c, g, or t
  modified_base (526)..(526): a, c, t, g, unknown or other
  misc_feature (526)..(526): n is a, c, g, or t
  modified_base (534)..(534): a, c, t, g, unknown or other
  misc_feature (534)..(534): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctggtggagtcgtgggggtaggtttggtccagccgtggggggtccctggagactctcgtgtgcgcctctggatcatctctaacaaactatggatgagcgtgggtcctcgaggctaccgaggggaggggctgggaggtgggtgccagcagtcgaacggagagtaggaacgtagaaaagacttagtggtaggaccttgtgtagaaacggggccctaaattccaaccagttcaccgagacgaaccaaacgcctaaagactanactagtatcctagacaaaatgaacagtaacctaaaggccccgaaagcctaaggctagtatacttacngtcggacngaacgaaccgtcgtaacggcgggggacccggacgtcccgtggtcccg

SEQ ID NO: 360485 - DNA, 545 bp, Homo sapiens
  misc_feature: GZ8MTXP02H6817.2.16.B05.1.454.CMB.2.raw
  modified_base (412)..(412): a, c, t, g, unknown or other
  misc_feature (412)..(412): n is a, c, g, or t
  modified_base (493)..(493): a, c, t, g, unknown or other
  misc_feature (493)..(493): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccaggccgtggggggtccctgagactctcgtgtgcggcctctggattcatctctacaaactattggatgagctgggtccgtcaggctccgaggggaaggggctgggaggtgggtggccagcatggaaacggagagtgggaaatacaaaaagactaatggtaggactcgtgtgaagggccattccacntctccagagacaacgccaaagactcactgtatctgacaaatgaaacagacctaagacccgagacacggctgtgtacttacngtcgacgagacgaaccgcgtaacgtcgggggcccggacgtcccgtggtcccg

SEQ ID NO: 360486 - DNA, 621 bp, Homo sapiens
  misc_feature: GZ8MTXP02FND3W.2.16.B05.1.454.CMB.2.raw
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctgggtggaggtcgtgggggaggtttggtccaggccgtggggggtccctgagactctcgtgtgcggcctctggattcatctctacaactatgatgagctggtccgtcaggctaccgaggggaaggggcgtgggaggtggggtggccgagcagtcggaacgggagagtagggaagtacaaaagactatggtaggactcgtggtaggaacgggccgtattccaccgtattccacgagacgaacaacgccaaagactcactgtanctanacgaaatcgaaacacgaccgtaaacgaccccggaaggacccgaacgggtctagggttactaaacgtttaccggtggtacgaccggaacgaacggtaaccccggtataacccggggtccggggggaaccccggaccgtccccggttacggtcccccg

SEQ ID NO: 360487 - DNA, 596 bp, Homo sapiens
  misc_feature: GZ8MTXP02IUGOK.2.16.B05.1.454.CMB.2.raw
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctgggtggagtcgtgggggtaggtttggtccagccgtggggggtccctgagactctcgtgtgcggcctctggtattcatctctaacaaactattggatgagcgtgggtccgtcgaggctccgaggggaaggggctgggaggtggggtcggccagcagtggaaacggagagtaggaaagtacaaaaagactatggtaggactcgtggtaggaaacgggcccgattccacctatcctaccaagacgaacaacgaccaaagaactcacttgtaatcganacaaanacgaaacacgaccgtaaacggacccgaaggaccgacggtctagttagttactacgtgtcgacgagacgaaccgtcgtacgggtccgggggacccggtacgtcccgtcggtccg

SEQ ID NO: 360488 - DNA, 609 bp, Homo sapiens
  misc_feature: GZ8MTXP02GPVF7.2.16.B05.1.454.CMB.2.raw
  modified_base (266)..(266): a, c, t, g, unknown or other
  misc_feature (266)..(266): n is a, c, g, or t
tcagacgctcgacacacgaccggtgctcgatttagagctcacgtattgggtttgaggtctcagagaggagccttagccctggactccaaggcctttccacttggtgatcatcactgagcacagaggactcaccatggaattggggctgagctgggttttccttgttgccattttagaaggtgtccagtgtgaggtgcagctggtggagtcgtgggggaggtttggtccagccgtggggggtccctgagactctcgtgtgcggcctntggattcatctctacaaactattggatgagcgtgggtccgtcaggctccgaggggaggggctgggagtggggtgccaggcagtcggaacggagagtagggaaatacaaaaagactaagtggtaggactcgtgtaggaaaggggcccgtattacccacctaatcctaccgaggacaacaaacgccaaaagaacctcaactgtatctgacaaaatcgaaacagaccctaaaaggaccccgaagggacctaaccgggtctaggttacttaaagttactggtcgaccggtaaggacgaaccggcgttaacgccggggggaccccggacggccccgttgggtaccccg

SEQ ID NO: 360489 - DNA, 643 bp, Homo sapiens
  misc_feature: GZ8MTXP02IF8PU.2.16.B05.1.454.CMB.2.raw
  modified_base (582)..(582): a, c, t, g, unknown or other
  misc_feature (582)..(582): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctggtggaggtcgtgggggaggtttggtccagccgtggggggtccctgagactctcgtgtgcggcctctggattcatctactaacaaactattggatgagtcgtgggtccgtgacggctccggaggggagggctgggaggtgggtcggccaggcagtacggaaacggagagtagggaaagtaaccgaaaaagtacgttagtaggtacgtaaccttcgtggtacggaaacgggggtccctaagttacccaactactcctaaccgaagacgaacaaacgccaaaagtacctactaacgtgtactacgtagaactaaaagtacgaaactaacgacccgtaaaacggacccggaacggaacgacggtcgtagttacgtattacgngtacgcgtaagacggaaccgtcggtaccgggtcgggggaccccgtcgacccgtggtacccg

SEQ ID NO: 360490 - DNA, 655 bp, Homo sapiens
  misc_feature: GZ8MTXP02FWWKS.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctggggaggtttggtccagccgtgggggtccctgagacctctcgtgtgcgcctcgtggatcatctctaacaaactagttggatgagcgtcgggtccgtcgaggcctaccggaaggggaaggggtcgtgggagggtggggtcggccgagctagtacggaaacgggagagtagggaacgtaacaaaagactagtggtaggactgtgtaggaacgggtccgtaattcccaacccattccctaccgaagaacgaaccgaaaccgaccgtaaaagaacctaccacttagttactacgtacgaaaccaaatacggaaacacggtaaccctaaacggacccggaaagaccgaacgggtcttaggtagttaacttacgtggtacgaccggaaagaccggaacccgtcgtaaccgggtccggggggaccccggtacggtcccccgtggtaccccg

SEQ ID NO: 360491 - DNA, 643 bp, Homo sapiens
  misc_feature: GZ8MTXP02IO3RT.2.16.B05.1.454.CMB.2.raw
  modified_base (593)..(593): a, c, t, g, unknown or other
  misc_feature (593)..(593): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggtaggtttggtccagccgtgggggtccctgagactcgtgtgtgcggcctcgtggtattcatctctaacaaactattggatgagcgtgggtccgtgacggctccgaggggaaggggcgtgggaggtgggtcggccaggcagtcggaaacgggtagaagtagggaaagttaacgaaaaagtactaagtggtacggacttcgtggtaacgggaacgggggccctattacccgaacctaacttccctaccgaaaggaacgaaccgaaacccgaccgaaaacgaacctaccgtaaccttaggttacttacaggacctaaaatcggaaaacacgaccgaaacgacccggaagacgaaccggtctaggttagtactttaacggngacgacgacgacgccgtacggtacgggccggggaccgcgtccgttcgccg

SEQ ID NO: 360492 - DNA, 655 bp, Homo sapiens
  misc_feature: GZ8MTXP02JUV0Q.2.16.B05.1.454.CMB.2.raw
  modified_base (207)..(207): a, c, t, g, unknown or other
  misc_feature (207)..(207): n is a, c, g, or t
tcagacgctcgacacacgaccggtgctcgatttagagctcacgtattgggtttgaggtctcagagaggagccttagccctggactccaaggcctttccacttggtgatcatcactgagcacagaggactcaccatggaattggggctgagctgggttttccttgttgccattttagaaggtgtccagtgtgaggtgcagctggtggngtacgtgggggaggtttggtccagccgtgggggtccctgagactctcgtgtgcggcctcgtggattcatctctaacaaactattggatgagcgtgggtccgtcaggctaccgaggggaggggctgggagtggggtcgccagcagtcggaacggagagtagggaagtacaaaagtactagtggtacgacttcgtggtaggaaacgggggtccctaatttacccaaccctattcccacccgaaaggaaccgaaccgaaacccggaccaaaacgaaccttaccgaaccttaggtacttccgtaagacctaaaatcgaaaccacgaacccgtaaacggaccccggaagggaccacgggtactgggtacttaacttccgtggtcggacgtaaggacggaacccgtacgttaacccggggcgggggaccccggtactccccggtagggtccccg

SEQ ID NO: 360493 - DNA, 730 bp, Homo sapiens
  misc_feature: GZ8MTXP02G55UI.2.16.B05.1.454.CMB.2.raw
  modified_base (470)..(470): a, c, t, g, unknown or other
  misc_feature (470)..(470): n is a, c, g, or t
  modified_base (600)..(600): a, c, t, g, unknown or other
  misc_feature (600)..(600): n is a, c, g, or t
  modified_base (705)..(705): a, c, t, g, unknown or other
  misc_feature (705)..(705): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctgggtggagtcggtgggggtaggtttggtccgaggccggtggggggtccctggagactctcggtgtgcggtcctcgtggattcatctctaactaaactatggatgagcgtcgggtccgtcgacggtcctaccggaggggtaaggggcgtgggagggtggggtcgacgagacgtagtacggaacgggagagtagggtaaacgtaacgaaaagtacgtagtgggtacggacttcgtaggtacggaaacgggggtcctattacccgaactnttacccgaccgaaggaaaccgaacccgaaacgaccaaaacgtaaccttcgaacttacggttaacttcgaacgaacttaaaacgaacgaaaccgacggtaacccgaaacgaccccggggaaggtaaaaccnccggggttactttaggggtaactttaacgttaccggtaggtacggaacggggacaacccgggaaccccggttacggtaacccgggggtccgggggaacccccggngttcccccggtagggttaccccccg

SEQ ID NO: 360494 - DNA, 645 bp, Homo sapiens
  misc_feature: GZ8MTXP02I1NIK.2.16.B05.1.454.CMB.2.raw
  modified_base (287)..(287): a, c, t, g, unknown or other
  misc_feature (287)..(287): n is a, c, g, or t
  modified_base (580)..(580): a, c, t, g, unknown or other
  misc_feature (580)..(580): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccaggccgtggggggtccctgagactctcgtgtgcggcctctggatcatctctacaaactnttggatgagcgtgggtccgtcaggctccgaggggaaggggcgtgggaggtgggtcgccagcagtcggaacggagagtaggaaagtacgaaaagactagtggtacggtactcgtagtagggaaacgggtcccgtaattcccgaacctattcccgtacccgaaggaaccgaaccaaaccggacccaaaagacctccaacgttaggtaactcgtagaacctaaagtacggaaacacgtacccgtaaaagaccccggaaggaacccacggggtacttagggttataaacgtttacgngtacggacgaaggaccggaaccgtacgtacggggccgggggacccgccgtcccggtacggtcccg

SEQ ID NO: 360495 - DNA, 616 bp, Homo sapiens
  misc_feature: GZ8MTXP02G9UC3.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccaggccgtggggggtccctgagactctcgtgtgcggcctctggattcatctctaacaaactattggatgagcgtgggtccgttaggctccgaggggagggctggaggtgggtgccagcagtgaaccggagataggaagtacaaaagactagtgtaggactcgtggtagaagggccattcactatctaccagacgacaacgaccaaagacctacaactgtaactccgtagaacctaaagtagaaaccacggtaaccaaacggaacccgagggaacccaacgggtccttaggtacgtttaagttaccgttggacgacggaacgaccggtacccgtaacggttaaccgggccgggggacccggacgtcccccggtgggtacccgtaaccccg

SEQ ID NO: 360496 - DNA, 633 bp, Homo sapiens
  misc_feature: GZ8MTXP02JM0N9.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgcctattttagaaggtgtccagtgtgaggtgcagctggtggagtcgtgggggtaggtttggccaggccgtggggggtccctgagactctcgtgtgcggcctctggattcatctactacaaactatggatgagcgtgggtccgtgaggctccgaggggaaggggctgggaggtggggtcggccgagcagtggaacggagagtagggaaagtacaaaaagtactagtggtaggactcgtaggtaggaacggggtcctacgttaccaccgtatccctacgaagacgaaccaaaccggaccaaagaacctacacttagtactctagaacctaaatacgaacaacgacctaaacggaccccggaagaccgacggtactaggttacgttaacttacggtcgcggaccgtaaggaccgtaacccggcgttaccggggtccgggggaccccggacgtcccccggtaggtacccccg

SEQ ID NO: 360497 - DNA, 555 bp, Homo sapiens
  misc_feature: GZ8MTXP02FNA8K.2.16.B05.1.454.CMB.2.raw
  modified_base (392)..(392): a, c, t, g, unknown or other
  misc_feature (392)..(392): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
  modified_base (444)..(444): a, c, t, g, unknown or other
  misc_feature (444)..(444): n is a, c, g, or t
  modified_base (502)..(502): a, c, t, g, unknown or other
  misc_feature (502)..(502): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctgagactctcgtgtgcggcctctggattcatctctaacaaactattggatgagctgggtccgtcaggctccgaggggaaggggctgggaggtggggtggccagcatggaaacggagatagggaagtacaaaaaggactatggtgactntggtagaagggccattccaccatcncaganacaacgccaaagactcatgtanctagacaaatgaaacagaccgtaaacgacccgaggacacggtctaggtgtacttacgngtgacgagacgaacccgtgtaccggtcgggggccccgtagccccgtggtcccg

SEQ ID NO: 360498 - DNA, 680 bp, Homo sapiens
  misc_feature: GZ8MTXP02JC61I.2.16.B05.1.454.CMB.2.raw
  modified_base (365)..(365): a, c, t, g, unknown or other
  misc_feature (365)..(365): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctggtggagtcgtgggggaggtttggtccaggccgtggggggtccctgagactctcgtgtgcggcctctggattcatctctacaaactattggatgagcgtgggtccgtcgaggcctaccgaggggaggggctgggaggtggggtcggccagcagtcggaacggnagtggaagtacaaaagactatggtaggacttgtggtaggaaacggggcccgtaattccgaacctattccctaccgaaggacgaaccaaaccgccaaaagaacctcgaacctagtaacttctagaactaaaatcgaaaccacggaacccgtaaaacggcccccgggaaaggaccgaacgggtccgttaggttacggttaaactttaaccgtcgggttacggaaccggtaaagggaacccggtaaccccggtaccggtttaacccggggccgggggggaccccccgggtaaggtccccccggttagggttacccccg

SEQ ID NO: 360499 - DNA, 575 bp, Homo sapiens
  misc_feature: GZ8MTXP02JTF0G.2.16.B05.1.454.CMB.2.raw
  modified_base (308)..(308): a, c, t, g, unknown or other
  misc_feature (308)..(308): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctgagactctcgtgtgcggcctctggattcatctctacaaactattggatgagcgtgggtccgtnaggctccgaggggaaggggcgtgggaggtggggtggccgagcagtaggaacgggagagtagggaagtacgaaaagactagtggtaggactcgtaggtggaacgggcctattcgacctatcctaccaagacgacaacgacaaagactcactgatcgtagacaaatgaacagacctaacgacccgagacacggtctgtagtacttactggtacgcgaagacgaaccgtcgtaacgggtcgggggaccccggacggcccgtggtaccccg

SEQ ID NO: 360500 - DNA, 577 bp, Homo sapiens
  misc_feature: GZ8MTXP02HXYH8.2.16.B05.1.454.CMB.2.raw
  modified_base (398)..(398): a, c, t, g, unknown or other
  misc_feature (398)..(398): n is a, c, g, or t
  modified_base (421)..(421): a, c, t, g, unknown or other
  misc_feature (421)..(421): n is a, c, g, or t
  modified_base (463)..(463): a, c, t, g, unknown or other
  misc_feature (463)..(463): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctggagactctcgtgtgcggcctctggattcatctctaacaaactattggatgagcgtgggtccgtcgaggcctccgaggggaaggggctggggaggtggggtggccgagcgatcggaacggagagtaggaagtacaaaagactagtgtagactntggtagaagggcctatcacatcncagacacaacgacaagactcactgtatctgacaaatgaaacncgaaccctaacggacccgaggaaccacgggtctaggtagttaacttacgtgtacggacgaagaccgaaccgtacgtacgggccgggggaccccggacgtcccgtacgggtcccc

SEQ ID NO: 360501 - DNA, 608 bp, Homo sapiens
  misc_feature: GZ8MTXP02J0AQV.2.16.B05.1.454.CMB.2.raw
  modified_base (283)..(283): a, c, t, g, unknown or other
  misc_feature (283)..(283): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgccattttagaaggtgtccagtgtgaggtgcagctggtggagtctgggggagtttggtccagccgtggggggtccctgagctctcgtgtgcggcctctggattcatctctacaaactnttggatgagctgggtccgtcaggctccgaggggaaggtgctggagtggggtcgccaggcagtggaacggagatggggaagtacaaaggactaatgtggacttcgtaggtgaaacgggggcccaagttccaaccatcctcccaagacgaacaacgccaaagaactcaactgtaactcgtagacctaaaatgaaaccaggaccctaaagggacccccgaaaggggacccaccggggtacgtgtacgttaacttaaccgtggtcgacggaacggaacggacccggtacgttacgggtccggggggccccggacggcccccgtttgggg

SEQ ID NO: 360502 - DNA, 573 bp, Homo sapiens
  misc_feature: GZ8MTXP02GEFZS.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctgagactctcgtgtgcggcctctggattcatctctaacaaactattggatgagcgtgggtccgtcaggctccgaggggaaggggctgggaggtggggtggccagcagtggaacggagagtaggaagtacaaaagactatggtaggactcgtgtagaaggggcccgtattccacctatcctccaagacgacaacgccaaagaacctcactgtactctagacaaaatcgaaacacgacctaaacgaccgagacacggctgtagtacttacgtgtcgacgtacgacgcccgtacgtacggtcgggggacccggacgtccccgtcggtacccg

SEQ ID NO: 360503 - DNA, 634 bp, Homo sapiens
  misc_feature: GZ8MTXP02GOOCQ.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccaggccgtggggggtccctgagactctcgtgtgcggcctctggattcatctctacaaactattggatgagctgggtccgtcaggctccgaggggaggggctgggagtgggtgccgagcatggaaacggagatagggaatacaaaagactatggtaggactcgtgtaggaaacgggccgaattccaaccattcctaccaagacgacaaacgaccaaagaactcaaactgtaactctagaactaaaagtgaaaaccaggaccctaaagggacccccgaagggaccaacgggtcttaggttacgttaacgtttaaaccgtggttacggaccggaaaggaacgaaccccggtacgttaaacccggggcggggggacccccgggtaacggtcccccgttaggggtacccccg

SEQ ID NO: 360504 - DNA, 610 bp, Homo sapiens
  misc_feature: GZ8MTXP02FS88X.2.16.B05.1.454.CMB.2.raw
  modified_base (266)..(266): a, c, t, g, unknown or other
  misc_feature (266)..(266): n is a, c, g, or t
  modified_base (287)..(287): a, c, t, g, unknown or other
  misc_feature (287)..(287): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctgggtggagtcgtgggggaggtttggtccagccgtggggggtccctgagactctcgtgtgcgcctntggattcatctctacaaactnttggatgagctgggtccgtcaggctccgagggagggctgggagtgggtggccagcatcggaacggagagtaggaagtacaaaaagtactagtggtaggacttcgtaggtaggaaacggggccgtaatttccgaaccatcctaccgaagacgaaccaaacgaccaaaagaacctacaactagtactctagaacaaatacgaaacacgacctaaacggacccgaaggacgaacggtctagtagttaacttacgtcggtcgacggagaacgaaccggtactaaccgggtccggggggaccccggacgtccccggtgggtaaccccg

SEQ ID NO: 360505 - DNA, 585 bp, Homo sapiens
  misc_feature: GZ8MTXP02JVI3N.2.16.B05.1.454.CMB.2.raw
  modified_base (269)..(269): a, c, t, g, unknown or other
  misc_feature (269)..(269): n is a, c, g, or t
  modified_base (497)..(497): a, c, t, g, unknown or other
  misc_feature (497)..(497): n is a, c, g, or t
  modified_base (504)..(504): a, c, t, g, unknown or other
  misc_feature (504)..(504): n is a, c, g, or t
  modified_base (530)..(530): a, c, t, g, unknown or other
  misc_feature (530)..(530): n is a, c, g, or t
  modified_base (546)..(546): a, c, t, g, unknown or other
  misc_feature (546)..(546): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctggtggagtcgtgggggaggtttggtccaggccgtggggggtccctggagctctcgtgtgcggcctcnggattcatctctacaaactattggatgagctgggtccgtcgaggcctaccgaggggaaggggcgtgggaggtggggtcggccaggcagtacggaacgggtagagtagggaaagtacaaaaaggtactagtggtaggtactcgtggtaggaaacggggtcccgtaatttaccgacctagtccctacccgaagacgaccaaaccgaccaaagaactcactgtactcgtanaacaaanacgaacacgaccaacggaccgagacncgtctagtagtactgngcgacgagacgccgcgtcggcggggccgcgccgtcgacc

SEQ ID NO: 360506 - DNA, 724 bp, Homo sapiens
  misc_feature: GZ8MTXP02HOR1V.2.16.B05.1.454.CMB.2.raw
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgccattttagaaggtgtccagtgtgaggtgcagctggtggagtcgtgggggtaggtttggccagccgtgggggtccctganactctcgtgngcgctctggattcatctactaacaaactattggatgagcgtggtccgtgacggctaccggaggggaggggctgggaggtgggtcggccaggctaagtaccggaacggagtagtagggaacgttacgaaaaagaccgtttagtggtacggtacgttacgttaggtagggaaacggggacccgtaattacccgaacacgttaccctaccaaagggacgaaccgaaaaccgtacccaaaagtaacctacgtaaacgttaggttaacttcgtaggaactaaaattaacggaaacctaacgtaacccgtaaacggaccccggaacggaaccgtacgggtaccttagggttaacgttaacgtttaaccgtggttaaccggacggtaaacggaaccgccccgggttaacggtaacccggggttccggggggaacccccggtaccgggtccccggtttaccggggtaacccccg

SEQ ID NO: 360507 - DNA, 625 bp, Homo sapiens
  misc_feature: GZ8MTXP02IG8RT.2.16.B05.1.454.CMB.2.raw
  modified_base (267)..(267): a, c, t, g, unknown or other
  misc_feature (267)..(267): n is a, c, g, or t
  modified_base (364)..(364): a, c, t, g, unknown or other
  misc_feature (364)..(364): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggtttccttgttgcctatttagaaggtgtccagtgtgaggtgcagcgtggtggagtcgtgggggaggtttggtccaggccgtggggggtccctgagactctcgtgtgcggctntggatcatctactacaaactattggatgagcgtgggtccgtgaggctacggaggggaaggggctagggaggtggggtgccagcagtacggaaacggngagtagggaataacgaaaagtactagtggtagactcgtaggtagaacgggtacccgtatcccaacatacctccgaaagacgaacaaaccgaccaaagaacctacaacgttgtaacttctagaactaaaagcgaaacacgaacctaaacggaacccgaaggaacctacgggtacttaggtagttacttaacgtggtacgacgaaggaacgaaccggcgttaacggggtccgggggaccggtaaccgtccggtacggtacccg

SEQ ID NO: 360508 - DNA, 613 bp, Homo sapiens
  misc_feature: GZ8MTXP02IT4SU.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggtaggtttggtccaggccgtggggggtccctgagactctcgtgtgcggctctggatcatctctacaaactattggatgagcgtgggtccgtcgaggcctaccgaggggaaggggctggggaggtggggtggccagcagtacggaacggagtagtaggaaagtacgaaaaagactatggtggactcgtggaggaacgggccgtattcaccatctaccagacgaacaaccgaccaaagaactacgaacttgtaactctagacaaaatgaaaccacgtaccgaaaacggaccccggaaaggaccgaacggtcgtaggttaggttaacttacgtggtcgacgacggtacggaacccgtcgtaacgggtcgggggaccccggagtcccccggtaggtccccg

SEQ ID NO: 360509 - DNA, 591 bp, Homo sapiens
  misc_feature: GZ8MTXP02JBCOC.2.16.B05.1.454.CMB.2.raw
  modified_base (357)..(357): a, c, t, g, unknown or other
  misc_feature (357)..(357): n is a, c, g, or t
  modified_base (477)..(477): a, c, t, g, unknown or other
  misc_feature (477)..(477): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctgagactctcgtgtgcggcctctggattcatctctacaaactattggatgagcgtgggtccgtcgaggctccgaggggaaggggctgggagtgggtggccagcatggaacggngagtgggaatacaaaaagtactagtggtggacttcgtggtagaaagggccgattccgacctatccctcaagacgaacaaccgcaaagacctacactgtactctagactaaaagtgaaacncgacccgtaaacgacccggaggaaccgacggacttggttatacttacgtggtcgaccggtagaacgaacccgtcgtacgggtcgggggaccccggacggcccgttagggtcccg

SEQ ID NO: 360510 - DNA, 562 bp, Homo sapiens
  misc_feature: GZ8MTXP02JTBX2.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgccattttagaaggtgtccagtgtgaggtgcagctggtggagtcgtgggggaggtttggtccagccgtgggggtccctgagactctcgtgtgcggcctctggattcatctctacaaactattggatgagctgggtcctcaggctcgagggagggctgggagtggtggccagcatcggaacggagagtaggaagtacgaaaagactatggtaggactcgtggtagaaacgggggccctaattccgaactactcgtaccagacgacaacgccaaagtactcactagtactctagacaaatcgaaacagtacctaagacccgtagacacggtctagtacgtacttacgcgtacgacgagacgccgtacgtacggcggggaccgacgtccgtacggtaccc

SEQ ID NO: 360511 - DNA, 598 bp, Homo sapiens
  misc_feature: GZ8MTXP02FLTNF.2.16.B05.1.454.CMB.2.raw
  modified_base (508)..(508): a, c, t, g, unknown or other
  misc_feature (508)..(508): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccaggccgtggggggtccctgagactctcgtgtgcggcctctggattcatctctacaaactattggatgagctgggtccgtcaggctccgaggggaaggggctgggagtggggtggccagcagtggaacggagagtaggaagtacaaaaagactagtggtaggactcgtggtaggaacggggtcccgaatttcccaaccctattccctacccgaaggaaccgaaccaaaaccggccctaaaagaacctcaaccttgtaactcgtagacctaaaatcgaaacnggacctaaacgacccgagacacggtctgtatacttgcgtgacgagacgaaccgtcgtacgggtcgggggacccgtacgcccgtaggtccc

SEQ ID NO: 360512 - DNA, 655 bp, Homo sapiens
  misc_feature: GZ8MTXP02HB67U.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctggtggagtcgtgggggtaggtttggtccagccgtgggggtccctggagctctcgtgtgcggcctctggatcatctctacaaactatggatgagcgtgggtccgtcgacggcctaccggaggggaaggggcgtaggggaggtggggtcggccgaggacagtacggaaacgggagagtaggaagtaacaaaagactagtggtaggactcgtaggtacggaaacggggccgtattaccgaccacttccacccgaaggaacgaaaccaaccgaccaaaacgaacctccaacgttagtacttcagaacaaactacggaaaccacgtaacccaaacgggacccccggaagggaacctaccgggtcttaggttagttaacttacggttggacgacggaagtacggaacccgtacgttaccgggggccgggggacccgaccggtcccgttcggtaccccg

SEQ ID NO: 360513 - DNA, 651 bp, Homo sapiens
  misc_feature: GZ8MTXP02G59R0.2.16.B05.1.454.CMB.2.raw
  modified_base (419)..(419): a, c, t, g, unknown or other
  misc_feature (419)..(419): n is a, c, g, or t
  modified_base (580)..(580): a, c, t, g, unknown or other
  misc_feature (580)..(580): n is a, c, g, or t
  modified_base (602)..(602): a, c, t, g, unknown or other
  misc_feature (602)..(602): n is a, c, g, or t
  modified_base (608)..(608): a, c, t, g, unknown or other
  misc_feature (608)..(608): n is a, c, g, or t
  modified_base (616)..(616): a, c, t, g, unknown or other
  misc_feature (616)..(616): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagcgtggtggagtcggtgggggtagtttggccgaggtccggtggggggtccctaggacgtctcgtcggtgtcggccggcccttcgtaggtacttctatcctactaactaaacttagttggatgacgtcgtcgggtccgtcgacggcctaccgggaagggggacggggtcgtaggggtaggttcggggtcggacccgaggcctaaggtacgggaaaagggngtaaggtaaggggaaacgtaacgaaaaagtacgttaagtggtacgtacgttcgtgggtagggaacggtccgtattaccaccgtatcctacgagacgaacaacgacaaagacctcatgtctacagataaatacgaacgcgtaaccgaacggaccgaaggacncggtactagggtactattacgngtacgngacgtacncgtactcggggccgggccgacggtccgtcgtcccg

SEQ ID NO: 360514 - DNA, 631 bp, Homo sapiens
  misc_feature: GZ8MTXP02JMKET.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggtaggtttggtccagccgtggggggtccctgagactctcgtgtgcggcctctggattcatctctaacaaactattggatgagcgtcgggtccgtcaggctccggaggggaaggggctggggaggttggggtcggccgaggcagtacggaacggagagtagggaaagtaacaaaagtactaagtggtaggacttcgtaggtaggaaacggggtccgtattaccgaccctatcctaccgaagacgaaccgaacgaccaaagaacctacacgttagtactcgtagactaaaagtcgaaacacgtaccctaaacggaccccgaagggacacggtcttagtagttaacttcgtaggtcgaccgaagtacggaacccgcgttaccgggccgggggacccggacgtccccggtggtaccccg

SEQ ID NO: 360515 - DNA, 638 bp, Homo sapiens
  misc_feature: GZ8MTXP02IYTUX.2.16.B05.1.454.CMB.2.raw
  modified_base (274)..(274): a, c, t, g, unknown or other
  misc_feature (274)..(274): n is a, c, g, or t
  modified_base (295)..(295): a, c, t, g, unknown or other
  misc_feature (295)..(295): n is a, c, g, or t
  modified_base (490)..(490): a, c, t, g, unknown or other
  misc_feature (490)..(490): n is a, c, g, or t
  modified_base (495)..(495): a, c, t, g, unknown or other
  misc_feature (495)..(495): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtcagtgtgaggtgcagctggtggagttcgtgggggtaggtttggtccaggccggtggggggtccctggagactctcggtgtgcggcctcgnggtatcatctctaacaaactntaggatgagtcgtgggtccgtcgaggcgtaccggaggggaaggggcgtggggaggtggggtcgaccgagcgagtacggaaacggagtagtaggaaagtaacgaaaaagtacgtatgggtagtactcgtaggagggaacgggtcctattccgacatcctacgaagacgaaccgaaacgacaaagaccttacacttntactnagaacaaagtacgaacaacgtaccgtaaaccgaccggtaacggacgacggtctaggttataaacgttccgagtacggacgtaagaaccggccgtaccgtacggggtaccgggggcccggtacccgtcccggtagggtaccccc

SEQ ID NO: 360516 - DNA, 786 bp, Homo sapiens
  misc_feature: GZ8MTXP02HNOKQ.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattgggctgagctgggttttccttgttgcctattttagaaggtgtccagtgtgaggtgcagctggtggagtcgtgggggtaggtttggtccaggccgtggggggtccctggagactcgtcgtgtggccggcctcgtggattcattctactaacaaactattggatgagtcgtgggtccgtcgaggcctaccggaaggggaacggggctaggggaggtggggtcggaccgaggaccagtacggaaacgggagtaagtaaggaaagtaacaaaaaaggtacttagtaggtacggacttcgtaggtacgggaaacggggccctaaagtttcccaaacccgtacttaccctacccgaaaggaaccgaaacccgaaaacccggaaccccaaaaggtaaacccttaccgaaaccgtttagttaacttcgtaacggaacctaaaaagtacggaaaacctacggtaaacccccgtaaaacggggaaccccccgaaaggggaaaccctaaccggggtaccgtttaggggtttaaccgtttaacgtttaaaccgtgggttacggaaccggaaacgggacccggtaaccccggtacgttaacccgggggtcccggggggaccccggtacccggtcccccggtttagggggtaccccccg

SEQ ID NO: 360517 - DNA, 563 bp, Homo sapiens
  misc_feature: GZ8MTXP02GGT07.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctgagactctcgtgtgcggcctctggattcatctctacaaactattggatgagcgtgggtccgtcaggctccgaggggaaggggcgtgggagtggggtggccagcagtcgaacggagatggaagtacaaaagactagtgtaggactcgtgtagaagggcccgattccgaccatctacagacgacaacgccaaagactacactgtatctagacaaaatcgaaacacgacctaaagacccgaggacacggtctagtgtaacttacgtgtagcgaagacgaacccgcgtacggcgggggaccccggagccccgtggtaccccg

SEQ ID NO: 360518 - DNA, 641 bp, Homo sapiens
  misc_feature: GZ8MTXP02GMDYY.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctggtggagtcggtgggggtaggtttggtccaggccgtggggggtccctgagctctcgtgtgcggcctctggattcatctctaacaaactattgatgagcgtgggtccgtcgaggctaccggaggggaaggggctgggaggtggggtggccagcagtaggaacggagagtaggaaacgtaacgaaaaagtactagtaggtaggtactcgtaggtaggaaacggggccgtattcaacctatccgtaccaagacgaacaacgaccaaaagacctacaaactgtaactctacgaacaaaagtacgaaaccgacgaacccgtaaaacggacccccgaaaggaccaaccgggtcttagttagttaacttacgtcggacgacgacgaaccgtaaccggtacggtaccggggccgggggacccggtaccgtcccggtacggtacccg

SEQ ID NO: 360519 - DNA, 533 bp, Homo sapiens
  misc_feature: GZ8MTXP02JRH18.2.16.B05.1.454.CMB.2.raw
  modified_base (264)..(264): a, c, t, g, unknown or other
  misc_feature (264)..(264): n is a, c, g, or t
  modified_base (283)..(283): a, c, t, g, unknown or other
  misc_feature (283)..(283): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (338)..(338): a, c, t, g, unknown or other
  misc_feature (338)..(338): n is a, c, g, or t
  modified_base (435)..(435): a, c, t, g, unknown or other
  misc_feature (435)..(435): n is a, c, g, or t
tcagacgctcgacacacgaccggtgctcgatttagagctcacgtattgggtttgaggtctcagagaggagccttagcctggactccaaggcctttccacttggtgatcagcactgagcacagaggactcaccatggaattgggctgagctgggtttcctgttgccattttagaaggtgtccagtgtgaggtgcagctggtggagtcgtgggggaggtttggtccagccgtgggggtccctgagtactctcgtgtgcggaccctntggattcatctcacaactnttggatgagctgggtcctcaggctccgaggaagggctaggggngtggngcagnanacgagagagagagagaagatagtagtgactgtgagagacgactacacactcacagacgacgaacgacacgaacacacgtagtactacgtacgacaanacgaacgacgacgacgacgacgacgacgtacgtagtagtacgtacgtacgtacgacgagacgaacgacgtacggtacgggaccggacgtccgtcgtcg

SEQ ID NO: 360520 - DNA, 616 bp, Homo sapiens
  misc_feature: GZ8MTXP02HJPR0.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattgggctgagctgggtttccttgttgccattttagaaggtgtccagtgtgaggtgcagctggtggagtcgtgggggaggtttggtccagccgtggggggtccctgagactctcgtgtgcggctctggattcatctctaacaaactagttggatgagctgggtccgtcaggctcgaggggaaggggctgggaggtgggtggccgagcagtacggaaacgggagagtggaaagtacgaaaaaagactagtggtacggtactctggtagaaggggccgtaattaccaccgaattcctaccgaagacgaacaaaccgaccaaaagactacacgtatatctagaacaaaatcgaaaacgacgacccgtaaaacggaccccggaagggtaaccaccggggtactggttagtaattaaccgtgtacggacgaggacgaacccgcttaacgggcgggggaccccgggactccccggtggtacccg

SEQ ID NO: 360521 - DNA, 649 bp, Homo sapiens
  misc_feature: GZ8MTXP02IKBUN.2.16.B05.1.454.CMB.2.raw
  modified_base (269)..(269): a, c, t, g, unknown or other
  misc_feature (269)..(269): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctggtggagtcgtgggggaggtttggtccaggccgtgggggtccctgagactctcgtgtgcggcctcnggattcatctctaacaaacttattaggatgagcgtgggtccgtcaggctccgaggggaagggcgtgggaggtggggtggccgagcagtacggaacggtagagtagggaagtaacgaaaagtactagtaggtaggactcgtggtaggaacgggcctagttccaacgtatccctacgagacgaaccaaacgctaaaagaccttcaactagtatcgtacgacgtaaaatgaaaccacgtacccgtaaaacggaccccgggaaggacccgaacggggtccttagggttagtaaccgtttacgcggtacgacggtaacggaccggtaacccgtcggttaaccggggtccgggggacccccggtacgtacccggtaccggtacccg

SEQ ID NO: 360522 - DNA, 569 bp, Homo sapiens
  misc_feature: GZ8MTXP02FLJ89.2.16.B05.1.454.CMB.2.raw
  modified_base (416)..(416): a, c, t, g, unknown or other
  misc_feature (416)..(416): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccaggccgtggggggtccctgagactctcgtgtgcggcctctggatcatctctacaaactattggatgagctggggtccgtcgaggcctccgaggggaaggggctggggagtggggtggccagcagtggaacggagagtggaaagtacaaaagactagtgtggactgtgtgaagggccattccaccatcnccagacgacaacgcaaagactcactgtactctagacaaatcgaaacacgacctaaacggaccccgagacgacggtctaggtagttaacttacgtggtcgacgagaacgaacccgcgtaacggtcgggggaccccgacgcccggtcggtacccg

SEQ ID NO: 360523 - DNA, 600 bp, Homo sapiens
  misc_feature: GZ8MTXP02GDS47.2.16.B05.1.454.CMB.2.raw
  modified_base (344)..(344): a, c, t, g, unknown or other
  misc_feature (344)..(344): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgcctattttagaaggtgtccagtgtgaggtgcagctggtggagtcggtgggggtaggtttggtccaggccgtggggggtccctggagtactctcggtgtcgcggcctcgtggattcatctactacaaactgtggatgagcgtgggtccgtcgaggctaccggaggggaggggctagggnggtgggtggccagcagtacggaacgggagagtaggaaagtaacgaaaaagactagtggtaggactcgtaggtagggaacggcgtattccacgtatcaccgagacaacacgacaaagacctcgactgtactcagactaaaatcgaaacacgtaccgtaaaaccgcccggaaggaaccgacgggtactgttagtaacttcgaggtcgacggagacgaaccgcgttaacggggcggggcccgacgtccgtacggtcccg

SEQ ID NO: 360524 - DNA, 558 bp, Homo sapiens
  misc_feature: GZ8MTXP02HG53I.2.16.B05.1.454.CMB.2.raw
  modified_base (511)..(511): a, c, t, g, unknown or other
  misc_feature (511)..(511): n is a, c, g, or t
  modified_base (529)..(529): a, c, t, g, unknown or other
  misc_feature (529)..(529): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgccattttagaaggtgtccagtgtgaggtgcagctggtggagtcgtgggggaggtttggtccagccgtggggggtccctgagactctcgtgtgcggcctctggattcatctctaacaaactattggatgagctgggtccgtcaggctccgaggggaaggggctgggaggtgggtggccaggcagtgaaacggagatgggaaatacaaaaagactatggaggactctgtagaaaggggcctattccaacatcctaccagacgaacaaacgcctaaaagactcactgtatcagacaaaatcgaaacagacctaaaggacccgagactacggactgtagtaacttacgngacgacgagacgaaccgngtaccggcggggacccgcgtccgtgtccg

SEQ ID NO: 360525 - DNA, 761 bp, Homo sapiens
  misc_feature: GZ8MTXP02G5LUS.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctggtggagtcgtgggggtaggtttggtccaggccgtgggggtccctgagactcgtcgtgtgcggcctcgtggattcatctctaacaaactattggatgagcgtgggtccgtcgaggcctccgaggggaaggggctgggaggtggggtggccagcagtaggaaacggagagtagggaaataacgaaaaaagtactagtggtacggtacttcgtggtagggaaacggggtccctaattacccgaaccctattcccgtacccgaaggaacgaaacccaaacccggaacccaaaagtaaccctacctaaacgttacgttaacttacgtacggaacctaaaaagttacggaaaaccaacggtaaccccgtaaaaccgggaacccccggtaacggggaaacccgtaaccgggggtacctttaaggggttacggtttaaactttacggttacggttacgggaccggtaaacggtaacccggaaacccccggttacggttaacccgggggttaccccggggggacccccgggtaacccggtcccccgggtttacgggttaccccccg

SEQ ID NO: 360526 - DNA, 576 bp, Homo sapiens
  misc_feature: GZ8MTXP02GDFC3.2.16.B05.1.454.CMB.2.raw
  modified_base (354)..(354): a, c, t, g, unknown or other
  misc_feature (354)..(354): n is a, c, g, or t
  modified_base (471)..(471): a, c, t, g, unknown or other
  misc_feature (471)..(471): n is a, c, g, or t
  modified_base (516)..(516): a, c, t, g, unknown or other
  misc_feature (516)..(516): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggagtttggtcagcctgggggtccctgagactctcgtgtgcggcctctggattcatctctaacaaactattggatgagctgggtccgtcgaggtctccgagggaaggggctgggagtggggtggcagcagtgaaacggngagtggaaagtacaaaaggactatgtaggactcgtaggtgaaacgggcccattcaaccaatctaccaagagaaccaaacgcccaaaagaaccttcaactagtactctagactaaaancgaaacagacctaaagcccgaagacacggctgtagtaattaccgnggtagaccgagacgaaccgtcgtaacggtcgggggaccccggacgcccctagggtacccg

SEQ ID NO: 360527 - DNA, 672 bp, Homo sapiens
  misc_feature: GZ8MTXP02F9ADY.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgcctattttagaaggtgtccagtgtgaggtgcagctggtggagtcgtgggggaggtttggtccaggccgtggggggtccctgagactcgtcgtgtgcggcctcgtggattcatctactaacaaacttagttaggatggacgtcgtacggggtcccgtcgacgggtcctacccgggaagggggtaacgggggccgtaggggtaggttcgggggtcgacccgtagaccgtagtacggaaacgggagtaagtagggaaacgtaacgaaaaagtactagtacgggtagaccttcgtaggtaagggaacggggaccctattacccgaacctactcccgtaccgaaagaacgaaccgaaaccgacccaaaagaacctaccgtactacgtactctagaacgaaatacgaaaccgactaccgaaacgaccccgaagacgacggactagggtatactacgtgacgacgacgaacgaaccgacgtacggaccgggggcccgacgcccgtagtccccg

SEQ ID NO: 360528 - DNA, 747 bp, Homo sapiens
  misc_feature: GZ8MTXP02GVBV2.2.16.B05.1.454.CMB.2.raw
  modified_base (297)..(297): a, c, t, g, unknown or other
  misc_feature (297)..(297): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcctattttagaaggtgtccagtgtgaggtgcagctggtggagtcgtgggggtaggtttggtccaggccggttggggggtccctggagactctcggtgtcgcggcctcgtggattcatctctaacaaactntgatgagcgtggtccgtgacggctaccggaggggaggggcgtgggaggtggggtggccgagcagtacggaacggagagtagggaaagtaacgaaaaagtactagtggtacggtactcgtaggtacggaaacgggggtccctaattacccgaacctactccctaaccgaaggaaccgaaacccaaaccggaccaaaagtaacccttacaacgttagtaactcgtaagaaaccgtaaaagtacgaaaccgaacggaaaccccgtaaaacgggaacccccggaaagggaaccccgaaccggggttaccttacggttaaagtttaaacgtttaccgtagggttacggaaccggtaaacgggtaaaccggaaccccggttaccggttaacccgggggtaccccgggggggaacccccggggtaccgtcccccggggtttaggggttaaccccccg

SEQ ID NO: 360529 - DNA, 684 bp, Homo sapiens
  misc_feature: GZ8MTXP02JHWBV.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttcctgttgccattttagaaggtgtccagtgtgaggtgcagctggtggagtcgtgggggtaggtttggtccaggccgtggggggtccctgagactctcgtgtgcggcctcgtggattcatctctaacaaactattggatgacgcgtgggtcccgtcgaggcctaccggaggggaaggggcgtaggggaggtggggtcggaccaggccagtacggaacggagagtaggaaagtaacaaaagtactagtggtaggacctgtaggtaggaaacgggtccgtattccgaacacgtccctacgaagacgaaccaaaccgaccgaaacgtaacctaccgtaacgttgtaaacttccgtaaggaacctaaaatacggaaaaccaacggtaaccccgtaaacgggaacccccggtaagggaaaccgaccggggttactaggttacgttaacgtttacgtggtacggacgtaaggaccggtaaccgtaccggtaaccggtccgggggaccccgacggtcccgtcggggtaccccg

SEQ ID NO: 360530 - DNA, 648 bp, Homo sapiens
  misc_feature: GZ8MTXP02GQEBL.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctggtggagtcgtgggggtaggtttggtccagccggtgggggtccctgagctcgtcgtgtgcgcctctggattcatctctaacaaactattggatgagtcgtggggtccgtcgaggctccggaggggaaggggcgtgggaggttggggtcggccagcagtagaacggagagtacggaaagtacaaaaagtacttatggtacggaccttgtggtagggaacggggtcctaagttccacctagtcctacccgaagaccgaacaaaccgaccaaaacgaactacaacgttgtatcgtagaactaaatacgaaacacgaaccgtaaacggaccccggaaggtaccgaacggtcgttagttacgttattaccggtggttacgacggtaacgacgtaacccggtcgttaaccggggaccggggggccccggacgtccccggtaggttaccccg

SEQ ID NO: 360531 - DNA, 592 bp, Homo sapiens
  misc_feature: GZ8MTXP02IBAE9.2.16.B05.1.454.CMB.2.raw
  modified_base (489)..(489): a, c, t, g, unknown or other
  misc_feature (489)..(489): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctgggtggagtcgtgggggtaggtttggtccaggccgtggggggtccctggagctctcgtgtgcggcctctggattcatctctacaaactattggatgagcgtggtccgtgaggctccgaggggaaggggctgggaggtgggtggccgagcgagtcggaaacgggagagtagggaagtacaaaagtactagtggtaggacttcgtggtaggaaacgggcccgtattccgaccatcctaccaagacgaacaaccgaccaaagactcactgtactctgacaaagtcgaaacncgacctaaacgaccccggaaggaccacgggtctagtagttacttaccgtgtcgacgagacgaaccgcgtacggtcgggggacccggacgtccccgtaggtccc

SEQ ID NO: 360532 - DNA, 617 bp, Homo sapiens
  misc_feature: GZ8MTXP02GJZ7D.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggtaggtttggtccagccgtgggggtccctgagactctcgtgtgcggcctcgtggattcatctctaacaaactattggatgagcgtgggtccgtcgaggctccgaggggaaggggctgggaggtggggtggccagcagtcggaaacggagtagtaggaagtaacaaaaagtactagtgtaggactcgtagtaggaacgggccgtattccaacgtactcctaccgaaagacgaaaccaacgaaccaaaacgaacttcaacgttagtaactctagaactaaaagacgaaacgacgaacccgtaaacgacccgaaggtaccacggtactacggtattatacgtggtacgaccgaggaccgtaacgaccgttacgggaccggggcccggacgcccggtgtaccccg

SEQ ID NO: 360533 - DNA, 697 bp, Homo sapiens
  misc_feature: GZ8MTXP02IMU9E.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttcctgttgcctattttagaaggtgtcagtgtgaggtgcagctggtggagtcgtgggggaggtttggcaggccgtgggggtccctgagactctcgtgtcgcggtcctcgtggtattcatctactaacaacttagttggatgagcgtgggtccgtcgacggcgtaccggaggggaacggggtcgtaggggtaggtgggtcggccgaggacaggtacggaaacgggagtagtaagggaaacgtaaaccgaaaaagtaccgttagttacggtacgggtacctagtagggtacggggaaacgggtccgtaacttccgaacctacttaccacgaaagaacgaaccgaacgaaccaaagaacctcaacgttagtaacttccgaagaactaaaacgacgaaacgtaccggtaaaccgtaaaccggaccgaacgggtaaccgacggttagttacgggtattaaccgtttacgcggtacggacgaacggacgtaacccgcgttaaccggggcccgggggtaacccgaccggttacccgccgtaacccg

SEQ ID NO: 360534 - DNA, 910 bp, Homo sapiens
  misc_feature: GZ8MTXP02HDLU2.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctggtggagtcgtgggggtaggtttggtccagccggtcgggggtccctgagtctcgtcgtgtgcggcctcgtggtattcatctactaactaaactagtggatgagcgtcgggtccgtcgaggccgtaccggaaggggaacggggtcgtggggacggttggggtcggccgtagacgtaagtacgggaaacggtaggaagtaagggtaaacgtaaaccgaaaaagtaacgttaaggttcgggtaacggtaccgttcggtagggtaggggtaaaccgggggtacccgttaactttacccgaacccttacgttacccgttaacccgaaaggaaccgaaaacccgtaaaccccggaaacctaaaacggtaaacccttaccgtaaccgtttaacggttaaccttaccggttacgaaaaccgttaaaaagttaccggaaaaaccgaccggtaaaacccccggttaaaacggaaccccccggggaaaacgggtaacccggggtaaccccgggtttaacgttacggggttttaaaccggtttaaaaccgtttttaacgggttaccggggttaccggtaaacccgggtaaaacggggaaacccccggggtaacccccgggtttaacggggtttaacccccggggggtaaccccggggggggaacccccccggggtaaccggggttccccccggtttaaaccgggggttaccccccccgg

SEQ ID NO: 360535 - DNA, 701 bp, Homo sapiens
  misc_feature: GZ8MTXP02HDGRW.2.16.B05.1.454.CMB.2.raw
  modified_base (318)..(318): a, c, t, g, unknown or other
  misc_feature (318)..(318): n is a, c, g, or t
  modified_base (462)..(462): a, c, t, g, unknown or other
  misc_feature (462)..(462): n is a, c, g, or t
  modified_base (622)..(622): a, c, t, g, unknown or other
  misc_feature (622)..(622): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttcctgttgcctatttagtaaggtgtccagtgtgaggtgcagcgtggtggaggtcggtgggggtagggtttggtccgaggtccggtcgggggtcccgtgagactctcgtgtgcggctcgtggatcatctctaacaaactattgatgagtcgtcggtccgngaggctacggaggggaaggggcgtgggaggtggggtcggccgaggacaggtacggaaacggggagaacgtaggggaaactaaacgaaaagacgtagtggtacggtactgtcggtagggaacgggtcctattcccgaacgttacncctacccgaaagaacgacccgtaaaccgaaacccgaaacgtacctaacccgtgtttaccgtatttacccgaacgaagtaaaaactcgggaaacccaagtacccccgtaaaacggacccggaacggacgaccggttaacttgggttaccttagttaaacgnggtcgggaaacgcggaaccgtcccgggtaccttacgggggcccggggacccccgggtagtcccccgtaggggtcccccc

SEQ ID NO: 360536 - DNA, 766 bp, Homo sapiens
  misc_feature: GZ8MTXP02I0P16.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctggtggagtcgtgggggaggtttggccagccgtgggggtccctgagctctcgtgtgcgcctcgtggattcatctctacaaactattggatgagcgtggtccgtcgaggcctaccggaggggaacggggctagggacgtggggtcggcctagcgatcggaaacggtagagtagggtaaagtaccgaaaaaggtaccgttaagttacgggtacggaccttcgtagggttacgggaaagggggtcccgtaaatttcccgaaccctaaagtcccttacccgaaagacgaacgaaaccgaccaaaagaacccttctaacgttacgtaacttcgtacgtaacgtaaaacgtacgaaaaccgtaacggtaccttaaaaacgggacccccggaaaagggtaaccccgtaaccgggtaccgttaagggtttacggttaaaccgttttaaccgtaggggtttacggaaaccggtagggaaaacccggttaaccccggacccggtttaaacccggggttcccgggggggaccccggtaaacccggttcccccggtttaggggtttaaaccccccg

SEQ ID NO: 360537 - DNA, 713 bp, Homo sapiens
  misc_feature: GZ8MTXP02F2D9B.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccaggccgtgggggtccctgagactctcgtgtgcggcctctggattcatctctacaaactattggatgagcgtgggtccgtcacggcgtaccgaggggaaggggctgggaggtggggtggccagcgagtacggaacggagtagtaggaaagtacaaaaagactagtaggtaggtactcgtaggtaggaaacggggcccgtattacccgaaccgtattcccgtaccgaagaacgaaccaaaccggacccaaaaaggaaacccttaccgaaacgttacgttacttacgtacggtaaacctaaaaagtaccgaaaacgaacggtaacccccgtaaaaaggaccccccggggaaaagggacccgaaccggggttacgttagggttacgtttaactttaccgtagggttcggaccggaaggtaccggaacccggtacgtaaccggggtaccgggggcccccggtacgggcccccgtttggggttaacccccg

SEQ ID NO: 360538 - DNA, 695 bp, Homo sapiens
  misc_feature: GZ8MTXP02I3IZQ.2.16.B05.1.454.CMB.2.raw
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagcgtggtggaggtcggtgggggtaggtttggtccacggtccggttcggggggtccctggacgtacctcgtcggtgtcggccggcctcgtggatcatctctacaaactattggatgagcgtgggtccgtcaggctccggaaggggaggggcgtgggaggtgggtcgacagcagtcgaacggganagtaggaanaccaaaaagcttagtggtacggtaacttcgtgggtacggaaacggggccgtaatttcccgaacctacgttccctacgaaagaccgaaaccaaacgaccgaaaacgaacctacctaacgttagttaacttacgtacgaacgtaaaacgtacgaaacgaacgtaacccgtaaaacgggacccggaacggaaaccgtaccggtaccgttaggttacgttacgttacggtgttacggcggaacgtacggaaccccgtaggtaaccgggtccgggggacccgggtaccgccccgggttggtacccccg

SEQ ID NO: 360539 - DNA, 630 bp, Homo sapiens
  misc_feature: GZ8MTXP02I3A5N.2.16.B05.1.454.CMB.2.raw
  modified_base (616)..(616): a, c, t, g, unknown or other
  misc_feature (616)..(616): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctggtggagtcgtgggggtaggtttggtccgaggccgtggggggtccctggagactcgtcgtgtgcggcctcgtggatcatctctaacaaactatggatgagcgtgggtccgtcgaggtctaccgaggggaaggggcgtgggaggtgggtcggaccagcaagtaggaaacggagagtagggaataacgaaaaagtactaagtggtagacttgtaggtaggaaacggggtccctaattcccgaaacctacgtaccctaaccgaaggaacaaacgaaaccgactaaacgaactcgaactgtactcagacaaaagtcgaaacacgacgtaaacgacccgaaggacctaccggtattggtaacttagttacgtggtacgacgaagacggaacccgcgtaacgggtccgggggaccggcnccccgtggtacccc

SEQ ID NO: 360540 - DNA, 628 bp, Homo sapiens
  misc_feature: GZ8MTXP02JQ1XY.2.16.B05.1.454.CMB.2.raw
  modified_base (263)..(263): a, c, t, g, unknown or other
  misc_feature (263)..(263): n is a, c, g, or t
  modified_base (285)..(285): a, c, t, g, unknown or other
  misc_feature (285)..(285): n is a, c, g, or t
  modified_base (454)..(454): a, c, t, g, unknown or other
  misc_feature (454)..(454): n is a, c, g, or t
  modified_base (488)..(488): a, c, t, g, unknown or other
  misc_feature (488)..(488): n is a, c, g, or t
  modified_base (511)..(511): a, c, t, g, unknown or other
  misc_feature (511)..(511): n is a, c, g, or t
  modified_base (565)..(565): a, c, t, g, unknown or other
  misc_feature (565)..(565): n is a, c, g, or t
  modified_base (625)..(625): a, c, t, g, unknown or other
  misc_feature (625)..(625): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctggtggagtcgtgggggagtttggccaggccgtgggggtccctgagctctcgtgtgcgctntggattcatctactacaaactnttggatgagtcgtcgggtcctagaggcctcggaaggggaaggggctgggacgttggggcgccgagtcagtcgggaaacggagattagggaaatacgaaaaagtactagtacggtaggtactcgtggtacggaaacggggcctattaccacccgtagtttcccaaagtanaaccgaaacacccgaaagacctcgaatcgttaanccttagaactaaagagaaacccnggaaccctaagacccggaggtaacccgtaggtccgtagttacgtactttacggngtacggacgacgcgaaccgtcggtacgggtccggggacccggacgtccggtacggtaccnccg

SEQ ID NO: 360541 - DNA, 569 bp, Homo sapiens
  misc_feature: GZ8MTXP02FKFBL.2.16.B05.1.454.CMB.2.raw
  modified_base (306)..(306): a, c, t, g, unknown or other
  misc_feature (306)..(306): n is a, c, g, or t
  modified_base (515)..(515): a, c, t, g, unknown or other
  misc_feature (515)..(515): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtggggggtccctgagctctcgtgtgcggcctctggattcatctctacaaactattggatgagctgggtccgtnaggctccgagggagggctgggagtggggtgccagcagtcggaacggagagtggaaagtacgaaaaaagactatggtaggactcgtggtagaaaggggtccctattccaacctatcctaccaagagacaaacgccaaaagaactcactgtaactctgacaaaatgaaacacgactaaacgacccgaaggacaacgggctgtatattacgngtacgcgaagacgaaccgctaacggtcgggggcccggtagccccgtaggacccg

SEQ ID NO: 360542 - DNA, 678 bp, Homo sapiens
  misc_feature: GZ8MTXP02HOEVW.2.16.B05.1.454.CMB.2.raw
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (533)..(533): a, c, t, g, unknown or other
  misc_feature (533)..(533): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctgggtggagtcgtgggggtaggtttggccaggccggtgggggtccctgagactctgtgtgcgctngatcatctcacaactnttgatgagtctgggtcctcgaggcctacggagggggaacggggcgtagggtaggggtggggtcggaccgtaggacctaaggtacggaaacgggagtagttagggaaagtaacaaaaagtacttaggtagtaggtaccgttcgtgggaacgggtaacgggtcccgtaatttcccgaaactacttccaacccgaagaacggaaacccaaccccggaacaaacgtaacctacctaccgtattaactcgtaaanaaaccgtaaaagaccgaaaacctacggaaacccgtaaaccggaccggtaagaccgtacgttcgttagttattaacttgtggaccgacgaagaaccggcccgtcggtaccgggggccggggacccgtcgtacccggtaggtacccc

SEQ ID NO: 360543 - DNA, 564 bp, Homo sapiens
  misc_feature: GZ8MTXP02I6P7V.2.16.B05.1.454.CMB.2.raw
  modified_base (360)..(360): a, c, t, g, unknown or other
  misc_feature (360)..(360): n is a, c, g, or t
  modified_base (393)..(393): a, c, t, g, unknown or other
  misc_feature (393)..(393): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
  modified_base (459)..(459): a, c, t, g, unknown or other
  misc_feature (459)..(459): n is a, c, g, or t
  modified_base (465)..(465): a, c, t, g, unknown or other
  misc_feature (465)..(465): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctggggggaggtttggtccaggccgtgggggggtccctggagactctcgtgtgcggcctctggattcatctctacaaaactattggatgagctgggtcctcaggctccgaggggaaggggctgggaggtgggtggccagcatggaaacggngatggaagtacaaaaagactaatgtcggaactntgtagaaagggccgaattcaaccattcnccganagacaaacaccaacgaaactacactatatatanacaaanaagaacaacgaacgaaacgaaccgaacgaacgacgacgtagtagtacttactagtcgacgagagaacgacgacgacggggaccggaccggccgacgtcg

SEQ ID NO: 360544 - DNA, 726 bp, Homo sapiens
  misc_feature: GZ8MTXP02FL46O.2.16.B05.1.454.CMB.2.raw
  modified_base (306)..(306): a, c, t, g, unknown or other
  misc_feature (306)..(306): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcgtgggggaggtttggtccagccgtgggggtccctgagactctcgtgtgcggcctctggattcatctctacaaactattggatgagctgggtccgtnaggctccgaggggaaggggctgggaggtggggtggccagcatcggaacggagagtaggaaagtacgaaaaagactagtggtaggactcgtaggtaggaaacggggccgtaatttcccgaaaccctacttcccgtacccgaaggaacgaaccgaaaacccggacccaaaaacggtaaccttaccgtaaccttaggttaactaccgtaggaacctaaaaagttacgaaaaccgtacgtaaccccgttaaaacgggaacccccggaaagggtaacccgaaccgggtaccgttagggttacgttaaactttacggtacggttacgggaaccgtaagggaaccggaaccccggttaccggtaaccggggttacccgggggggacccccggggtaacggtcccccgggttcggggttaccccccgg

SEQ ID NO: 360545 - DNA, 638 bp, Homo sapiens
  misc_feature: GZ8MTXP02GZWWV.2.16.B05.1.454.CMB.2.raw
  modified_base (266)..(266): a, c, t, g, unknown or other
  misc_feature (266)..(266): n is a, c, g, or t
  modified_base (505)..(505): a, c, t, g, unknown or other
  misc_feature (505)..(505): n is a, c, g, or t
  modified_base (508)..(508): a, c, t, g, unknown or other
  misc_feature (508)..(508): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgcctatttagaaggtgtccagtgtgaggtgcagcgtggtggagtcgtgggggtaggtttggtccagccggtgggggtcctgagctcgtcgtgtgcgcctgngtatcactctactaactaaactgtaggagtgacgtcggtcgggtcgtacggacgtccgtacggggaaggggacggggtcgtaggggtgggtaggggcggaccgagacgtagtacggaaggagtaggaaggtaaagaaacgaaaagtacgtagtgggtacggtacctggtaggtagggacggtcctattacccgatactcgtaccgagacaacaacgacaaaagcactatagtactcganaanaaacgtacgaaaacgcgtaaacccgaaacggaccgaacggtccaacggtctaggtacttacgtgttagacgacgagacgccggtacgtcgggggaccccggggaccgtccggttccggacgttaccccgg
